US011781148B2

United States Patent
Aeling et al.

(10) Patent No.: US 11,781,148 B2
(45) Date of Patent: Oct. 10, 2023

(54) BIOLOGICAL METHODS FOR PREPARING TERPENES

(71) Applicant: Radici Chimica S.p.A., Bergamo (IT)

(72) Inventors: Kimberly Ann Aeling, San Clemente, CA (US); Pierre-Yves De Wals, Encinitas, CA (US); Eric Scott, Encinitas, CA (US); Michael Waldbridge, Saugus, MA (US); Thomas Beardslee, Carlsbad, CA (US)

(73) Assignee: Radici Chimica S.p.A., Bergamo (IT)

( * ) Notice: Subject to any disclaimer, the term of this patent is extended or adjusted under 35 U.S.C. 154(b) by 245 days.

(21) Appl. No.: 16/630,567

(22) PCT Filed: Jul. 11, 2018

(86) PCT No.: PCT/US2018/041579
§ 371 (c)(1),
(2) Date: Jan. 13, 2020

(87) PCT Pub. No.: WO2019/014310
PCT Pub. Date: Jan. 17, 2019

(65) Prior Publication Data
US 2021/0079408 A1 Mar. 18, 2021

Related U.S. Application Data

(60) Provisional application No. 62/532,297, filed on Jul. 13, 2017.

(51) Int. Cl.
| C12N 15/81 | (2006.01) |
| C12N 1/16 | (2006.01) |
| C12N 15/52 | (2006.01) |
| C12P 7/44 | (2006.01) |

(52) U.S. Cl.
CPC ............. *C12N 15/815* (2013.01); *C12N 1/16* (2013.01); *C12N 15/52* (2013.01); *C12P 7/44* (2013.01)

(58) Field of Classification Search
None
See application file for complete search history.

(56) References Cited

U.S. PATENT DOCUMENTS

| 2003/0044946 A1 | 3/2003 | Longo |
| 2004/0265980 A1* | 12/2004 | Zhang ...................... C12P 7/44 435/134 |
| 2013/0066035 A1 | 3/2013 | Burgard et al. |
| 2013/0302861 A1 | 11/2013 | Vainstein et al. |
| 2014/0113343 A1 | 4/2014 | Daviet et al. |
| 2015/0010978 A1 | 1/2015 | Heaps et al. |

FOREIGN PATENT DOCUMENTS

| JP | 2012254044 A | | 12/2012 |
| WO | WO 2008/073367 | * | 6/2008 |
| WO | 2014100504 A2 | | 6/2014 |
| WO | 2018094110 A2 | | 5/2018 |

OTHER PUBLICATIONS

Juretzek et al., "Comparison of Promoters Suitable for Regulated Overexpression of β-Galactosidase in the Alkane-Utilizing Yeast *Yarrowia lipolytica*", Biotechnol. Bioprocess Eng. 2000, 5: 320-326.*
International Preliminary Report on Patentability of PCT/US2018/041579 dated Dec. 2, 2019.
Search Report and Written Opinion of PCT/US18/41579 dated Sep. 13, 2018.
Written Opinion of the International Preliminary Examining Authority of PCT/US2018/041579 dated Sep. 13, 2019.

* cited by examiner

*Primary Examiner* — Suzanne M Noakes
(74) *Attorney, Agent, or Firm* — SILVIA SALVADORI, P.C.; Silvia Salvadori

(57) ABSTRACT

The technology relates in part to biological methods for producing terpenes and to engineered cells and microorganisms capable of such production.

3 Claims, 59 Drawing Sheets
Specification includes a Sequence Listing.

FIG. 25A

| | | | |
|---|---|---|---|
| CvCAT2 from pAA426 | (1) | MFMFKLSQVLKQSTKEIAPILKKPETSHAKGDLFYQSQLFKLPVPTL | SEQ ID NO: 496 |
| CvCAT2(-mts) | (1) | ------------------MPILKKPFSTSHAKGDLFKKQSQLPKLPVPTL | SEQ ID NO: 497 |
| CvCAT2(-mts-pts) | (1) | ------------------MPILKYPFSTSHAKGDLFKYQSQLPKYQSQLPKLPFTL | SEQ ID NO: 498 |
| CvCAT3(-pts) | (1) | MFMFKLSQVLKQSTKEIAPILKKPETSHAKGDLFYQSQLPKLPVTTL | SEQ ID NO: 499 |

FIG. 25B

| | | | |
|---|---|---|---|
| CvCAT2 from pAA426 | (601) | KWYLVDSAMEMKFVLTKGLLLTDAEPKL- | SEQ ID NO: 500 |
| CvCAT2(-mts) | (583) | KWYLVDSANEDKFVLEKGLLLTDASFEL- | SEQ ID NO: 501 |
| CvCAT2(-mts-pts) | (560) | KWYLVDSANEAKVTKGLITRAK----- | SEQ ID NO: 502 |
| CvCAT3(-pts) | (601) | KWYLVDSANEMKFVLTKGLLTDAK----- | SEQ ID NO: 503 |

```
                       1                                                50
CvYat1p         (1) ——————————————————————————————MSTYQFQETLEKLPIPD  SEQ ID NO: 504
CvYat1p+CAT2mts (1) MENFKLSQQVLKNSTKSIMPILKKP-FSTSHAKGSTYQFQETLEKLPIPD  SEQ ID NO: 505
CvYat1p+CIT1mts (1) ————————MSALRSFQRSSNVAKST——LKNSVRTYSTYQFQETLEKLPIPD  SEQ ID NO: 506
CvYat1p+COX4mts (1) ————————MLSRTTLRVARQQTPLLSTSRILPNSKTDQSTYQFQETLEKLPIPD  SEQ ID NO: 507
```

FIG. 27

SEQ ID NO: 508

```
MPTELQKERFLTKFNPKELNYLEGSQBSEISNMVEQMQKDPILDA   50
QNLTKDQRETAKKIRLYHEYRHDKLDRTR                   100
GVMGLFSCVRGNGTNSOFFYWTINKGDLRGIYGCFQMTELAHGSN   150
VQGIETATFDEDTDEFVINTPHIGATKWWIGGAAHSATHCSVYARLKVK 200
GKDYGVKTFVVPLRDSNHDLEPGVTVGDIGAKMGRDGIDNGWIQFSNVRI 250
PRFFMLQKECKVSRSGEVTMPFSEQLSYSALIGRVMDSYMTSRFI   300
TIALRVAIHRQFKKDTDTTETKLIDYPLHQKRLFPFLAAYLFGGA   350
LSIMAINDRLDEAVSGEKEAIISKKLFVASGCLKSTCTWLE      400
ABAIDEARQACGGHGYSSYNGFGAYSDWVQCTWEGDNNILAMNVAKPM 450
VPDLPKAIESYADDPKABSHALSGLADIGAEG               500
DITGPSLVLVSKLNAHFLIGFRITPEEVIPLGLYADWILLTN     550
FGATFLQYGIITPDVSKNISSEHFPALCAKVRPNVVGLTDGFNITLTN 600
AAIGRYDGNVYEHYFEWVKANPPENTKAPYSKALE            636
```

| Residue highlight | HotSpot score |
|---|---|
| RESIDUE | 9 |
| RESIDUE | 8 |
| RESIDUE | 7 |
| RESIDUE | 6 |

BIOLOGICAL METHODS FOR PREPARING TERPENES

This application is a U.S. national stage of PCT/US2018/041579 filed on 11 Jul. 2018, which claims priority to and the benefit of U.S. Provisional Application No. 62/532,297, filed on 13 Jul. 2017, the contents of which are incorporated herein by reference in their entireties.

RELATED PATENT APPLICATIONS

This patent application claims the benefit of U.S. provisional patent application No. 62/532,297, filed on Jul. 13, 2017, entitled BIOLOGICAL METHODS FOR PREPARING TERPENES, naming Kimberly Ann Aeling as inventor, and designated by. This patent application is related to an International patent application, filed simultaneously herewith, entitled BIOLOGICAL METHODS FOR MODIFYING CELLULAR CARBON FLUX, naming Tom Beardslee as inventor, and designated by which claims the benefit of U.S. provisional patent application No. 62/532,292, filed on Jul. 13, 2017, entitled BIOLOGICAL METHODS FOR MODIFYING CELLULAR CARBON FLUX, naming Tom Beardslee as inventor. This patent application also is related to U.S. provisional patent application No. 61/222,902 filed on Jul. 2, 2009, entitled BIOLOGICAL METHODS FOR PREPARING ADIPIC ACID, naming Stephen Picataggio as inventor. This patent application also is related to International patent application no. PCT/US2010/040837 filed on Jul. 1, 2010, entitled BIOLOGICAL METHODS FOR PREPARING ADIPIC ACID, naming Stephen Picataggio and Tom Beardslee as inventors. This patent application also is related to U.S. provisional patent application No. 61/430,097 filed on Jan. 5, 2011, entitled BIOLOGICAL METHODS FOR PREPARING ADIPIC ACID, naming Stephen Picataggio and Tom Beardslee as inventors. This patent application also is related to U.S. provisional patent application No. 61/482,160 filed on May 3, 2011, entitled BIOLOGICAL METHODS FOR PREPARING ADIPIC ACID, naming Stephen Picataggio and Tom Beardslee as inventors. This patent application also is related to U.S. patent application Ser. No. 13/245,777 filed on Sep. 26, 2011, entitled BIOLOGICAL METHODS FOR PREPARING ADIPIC ACID, naming Stephen Picataggio and Tom Beardslee as inventors. This patent application also is related to U.S. patent application Ser. No. 13/245,780 filed on Sep. 26, 2011, entitled BIOLOGICAL METHODS FOR PREPARING ADIPIC ACID, naming Stephen Picataggio and Tom Beardslee as inventors. This patent application also is related to U.S. patent application Ser. No. 13/245,782 filed on Sep. 26, 2011, entitled BIOLOGICAL METHODS FOR PREPARING ADIPIC ACID, naming Stephen Picataggio and Tom Beardslee as inventors. This patent application also is related to International patent application no. PCT/US2012/020230 filed on Jan. 4, 2012, entitled BIOLOGICAL METHODS FOR PREPARING ADIPIC ACID, naming Stephen Picataggio and Tom Beardslee as inventors. This patent application also is related to International patent application no. PCT/US2012/056562 filed on Sep. 21, 2012, entitled BIOLOGICAL METHODS FOR PREPARING ADIPIC ACID, naming Stephen Picataggio and Tom Beardslee as inventors. This patent application also is related to U.S. provisional patent application No. 62/136,350 filed on Mar. 20, 2015, entitled BIOLOGICAL METHODS FOR PREPARING 3-HYDROXYPROPIONIC ACID, naming Eric Michael Knight as inventor. This patent application also is related to International patent application no. PCT/US2016/023243 filed on Mar. 18, 2016, entitled BIOLOGICAL METHODS FOR PREPARING 3-HYDROXYPROPIONIC ACID, naming Eric Michael Knight as inventor. This patent application also is related to U.S. provisional patent application no. 61/505,092 filed on Jul. 6, 2011, entitled BIOLOGICAL METHODS FOR PREPARING SEBACIC ACID naming Stephen Picataggio and Tom Beardslee as inventors. This patent application also is related to U.S. provisional patent application No. 61/523,216 filed Aug. 12, 2011, entitled BIOLOGICAL METHODS FOR PREPARING DODECANEDIOIC ACID naming Stephen Picataggio and Tom Beardslee as inventors. This patent application also is related to International patent application no. PCT/US2012/045615 filed on Jul. 5, 2012, entitled BIOLOGICAL METHODS FOR PREPARING A FATTY DICARBOXYLIC ACID, naming Tom Beardslee, Stephen Picataggio, L. Dudley Eirich and Jose Miguel Laplaza as inventors. This patent application also is related to International patent application no. PCT/US2012/045622 filed on Jul. 5, 2012, entitled BIOLOGICAL METHODS FOR PREPARING A FATTY DICARBOXYLIC ACID, naming Tom Beardslee, Stephen Picataggio, Alex Hutagalung and Tom Fahland as inventors. This patent application also is related to U.S. patent application Ser. No. 14/131,170 filed on Apr. 14, 2014 entitled BIOLOGICAL METHODS FOR PREPARING A FATTY DICARBOXYLIC ACID, naming Tom Beardslee, Stephen Picataggio, L. Dudley Eirich and Jose Miguel Laplaza as inventors. This patent application also is related to U.S. patent application Ser. No. 14/131,174 filed on Apr. 28, 2014, entitled BIOLOGICAL METHODS FOR PREPARING A FATTY DICARBOXYLIC ACID, naming Tom Beardslee, Stephen Picataggio, Alex Hutagalung and Tom Fahland as inventors. This patent application also is related to U.S. provisional patent application No. 61/739,656 filed Dec. 19, 2012, entitled BIOLOGICAL METHODS FOR PREPARING A FATTY DICARBOXYLIC ACID naming Jose Laplaza, Tom Beardslee, Dudley Eirich and Stephen Picataggio as inventors. This patent application also is related to U.S. provisional patent application No. 61/739,661 filed Dec. 19, 2012, entitled BIOLOGICAL METHODS FOR PREPARING A FATTY DICARBOXYLIC ACID naming Tom Beardslee, Alex Hutagalung and Stephen Picataggio as inventors. This patent application also is related to International patent application no. PCT/US2013/076664 filed on Dec. 19, 2013, entitled BIOLOGICAL METHODS FOR PREPARING A FATTY DICARBOXYLIC ACID, naming Jose Laplaza, Tom Beardslee, Dudley Eirich and Stephen Picataggio as inventors. This patent application also is related to International patent application no. PCT/US2013/076739 filed on Dec. 19, 2013, entitled BIOLOGICAL METHODS FOR PREPARING A FATTY DICARBOXYLIC ACID, naming Tom Beardslee, Alex Hutagalung and Stephen Picataggio as inventors. This patent application also is related to U.S. patent application Ser. No. 14/654,442 filed on Jun. 19, 2015 entitled BIOLOGICAL METHODS FOR PREPARING A FATTY DICARBOXYLIC ACID, naming Jose Laplaza, Tom Beardslee, Dudley Eirich and Stephen Picataggio as inventors. This patent application also is related to U.S. patent application Ser. No. 14/654,458 filed on Jun. 19, 2015, entitled BIOLOGICAL METHODS FOR PREPARING A FATTY DICARBOXYLIC ACID, naming Tom Beardslee, Alex Hutagalung and Stephen Picataggio as inventors. This patent application is also related to U.S. provisional patent application No. 62/011,500 filed on Jun. 12, 2014 entitled PURIFICATION OF POLYCARBOXYLIC ACIDS, naming Jose Laplaza as inventor. This patent application is also related to U.S. patent application Ser. No.

14/738,600 filed on Jun. 12, 2015 entitled PURIFICATION OF POLYCARBOXYLIC ACIDS, naming Jose Laplaza, William Andrew Evanko and Jason H. Radany as inventors. This patent application also is related to International patent application no. PCT/US2015/035634 filed Jun. 12, 2015 entitled PURIFICATION OF POLYCARBOXYLIC ACIDS, naming Jose Laplaza as inventor. The entire content of each of the foregoing patent applications is incorporated herein by reference, including, without limitation, all text, tables and drawings.

FIELD

The technology relates in part to biological methods for producing terpenes and to engineered cells and microorganisms capable of such production.

BACKGROUND

Cells and microorganisms employ various enzyme-driven biological pathways to support metabolism and growth. A cell synthesizes native proteins, including enzymes, in vivo based on the sequence of deoxyribonucleic acid (DNA) encoding the protein. DNA first is transcribed into a complementary ribonucleic acid (RNA) that contains a ribonucleotide sequence encoding the protein. RNA then directs translation of the encoded protein by interaction with various cellular components, such as ribosomes. When the resulting protein is an enzyme, it can participate as a biological catalyst in biochemical pathways involved in producing a variety of organic molecules by the cell or organism.

These pathways can be exploited for the harvesting of naturally produced organic molecules. The pathways also can be altered to increase production or to produce specific molecules that may be commercially valuable. Advances in recombinant molecular biology methodology allow researchers to isolate DNA from one cell or organism and insert it into another cell or organism, thus altering the cellular synthesis of enzymes or other proteins. Advances in recombinant molecular biology methodology also allow endogenous genes, carried in the genomic DNA of a cell or microorganism, to be increased in copy number, thus altering the cellular synthesis of enzymes or other proteins. Such genetic engineering can change the biological pathways within the host cell or organism, causing it to produce a desired product. Microorganic industrial production can minimize the use of caustic chemicals and the production of toxic byproducts, thus providing a "clean" source for certain compounds. The use of appropriate plant-derived feedstocks allows production of "green" compounds while further minimizing the need for and use of petroleum-derived compounds.

SUMMARY

Provided herein in certain aspects are genetically modified microorganisms comprising one or more heterologous nucleic acids encoding one or more terpene biosynthesis polypeptides, where expression of at least one of the heterologous nucleic acids is regulated by a nucleic acid that provides for fatty acid or alkane induction of expression of the terpene biosynthesis polypeptide. Also provided herein in certain aspects are genetically modified microorganisms comprising one or more heterologous nucleic acids encoding one or more terpene biosynthesis polypeptides, and a genetic modification that alters the expression of a polypeptide providing for transport of acetyl-carnitine in the microorganisms. Also provided herein in certain aspects are methods for producing a terpene comprising contacting a genetically modified microorganism provided herein with a feedstock comprising a carbon source, and culturing the microorganism under conditions in which the terpenes are produced from the feedstock.

Also provided herein in certain aspects is a genetically modified *Candida viswanathii* yeast, comprising one or more heterologous nucleic acids encoding one or more terpene biosynthesis polypeptides. Also provided herein in certain aspects are methods for producing a terpene comprising contacting a genetically modified *Candida viswanathii* yeast provided herein with a feedstock comprising a carbon source, and culturing the microorganism under conditions in which the terpenes are produced from the feedstock.

Also provided in certain aspects is a genetically modified yeast comprising one or more heterologous nucleic acids encoding phytoene synthase, geranylgeranyl diphosphate synthase and phytoene desaturase. Also provided in certain aspects is a genetically modified yeast comprising one or more heterologous nucleic acids encoding geranylgeranyl diphosphate synthase, phytoene desaturase and bifunctional lycopene cyclase/phytoene synthase. Also provided in certain aspects is a genetically modified yeast comprising one or more heterologous nucleic acids encoding geranylgeranyl diphosphate synthase, phytoene desaturase, bifunctional lycopene cyclase/phytoene synthase, β-carotene ketolase, β-carotene hydroxylase, astaxanthin synthase, and cytochrome p450 reductase.

Certain embodiments are described further in the following description, examples, claims and drawings.

INCORPORATION BY REFERENCE

All publications, patents and patent applications, GEN-BANK sequences (e.g., available at the World Wide Web Uniform Resource Locator (URL) ncbi.nlm.nih.gov of the National Center for Biotechnology Information (NCBI), sequences available through other databases, and websites and other published materials referred to throughout the entire disclosure herein, unless noted otherwise, are incorporated by reference in their entirety. Citation of any publications, patents and patent applications, GENBANK (and other database) sequences, websites and other published materials herein is not an admission that any of the foregoing is pertinent prior art, nor does it constitute any admission as to the contents or date of these publications or documents.

BRIEF DESCRIPTION OF THE DRAWINGS

The drawings illustrate certain embodiments of the technology and are not limiting. For clarity and ease of illustration, the drawings are not made to scale and, in some instances, various aspects may be shown exaggerated or enlarged to facilitate an understanding of particular embodiments.

FIG. 3B shows the locus after the integration of the knock-in cassette which incorporates the functional URA3 selection gene. To remove the URA3 gene, transformants are grown in the presence of 5-FOA to facilitate a "loop-out" event that is driven by the direct repeat sequences on either side of the URA3 gene (in this case $P_{URA3}$). The result of that event is shown in FIG. 3C which depicts the $P_{URA3}$ sequence that remains followed by the functional GOI2 cassette.

The details of the modifications in this exemplary engineered platform system are provided in the Detailed Description that follows.

Figure 6:
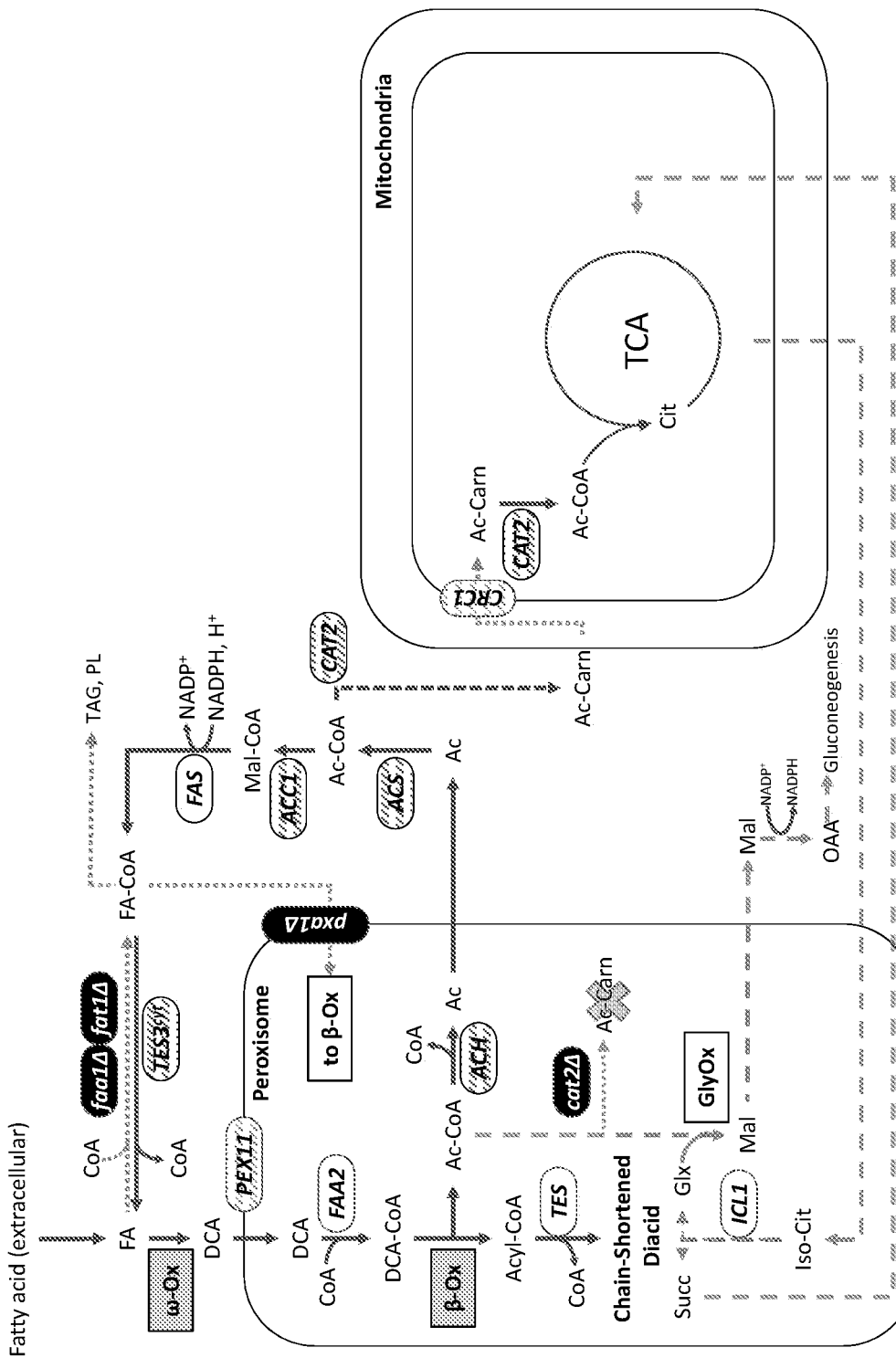
FIG. 6 is a schematic illustration of an engineered carbon flux pathway of a modified cell for use in producing a target molecule. The figure depicts cellular modifications in some embodiments of a eukaryotic (i.e., yeast in this example) platform system for developing particular target molecule production systems. The platform system is similar to that shown in FIG. 5 except for the following: modified (gene deletion) peroxisomal carnitine acetyltransferase ("cat2Δ") showing disrupted (lightly shaded dotted line reaction arrow) generation of peroxisomal acetyl-carnitine (AC-Carn shown with an "X" over it); modified and added peroxisomal acetyl-CoA hydrolase for converting acetyl-CoA (AC-CoA) to acetate ("Ac"); modified (promoter replacement) cytosolic acetyl-CoA synthetase ("ACS") activity.
Figure 7:
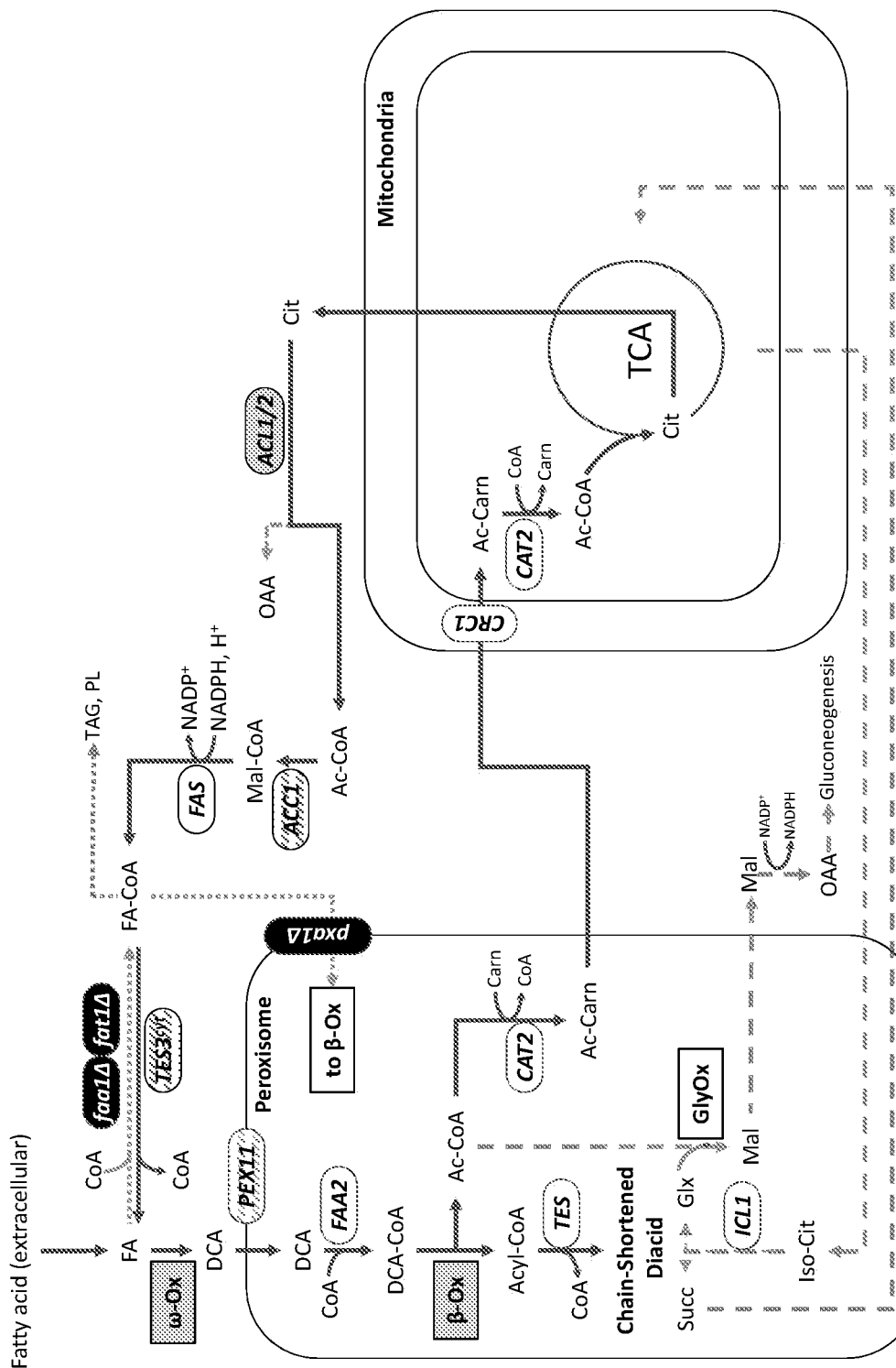

FIG. 7 is a schematic illustration of an engineered carbon flux pathway of a modified cell for use in producing a target molecule. The figure depicts cellular modifications in some embodiments of a eukaryotic (i.e., yeast in this example) platform system for developing particular target molecule production systems. The carbon recycle loop in this platform system, depicted by the dark, solid reaction arrows, extends through mitochondrial metabolism and differs from that shown in FIGS. 5 and 6. The mitochondrial acetyl-carnitine transporter ("CRC1") and carnitine acetytransferase ("CAT2") are unmodified in this exemplary platform system. A cytosolic ATP citrate lyase ("ACL1/2") activity is added to the system. The details of the modifications in this exemplary engineered platform system are provided in the Detailed Description that follows.

Figure 8:
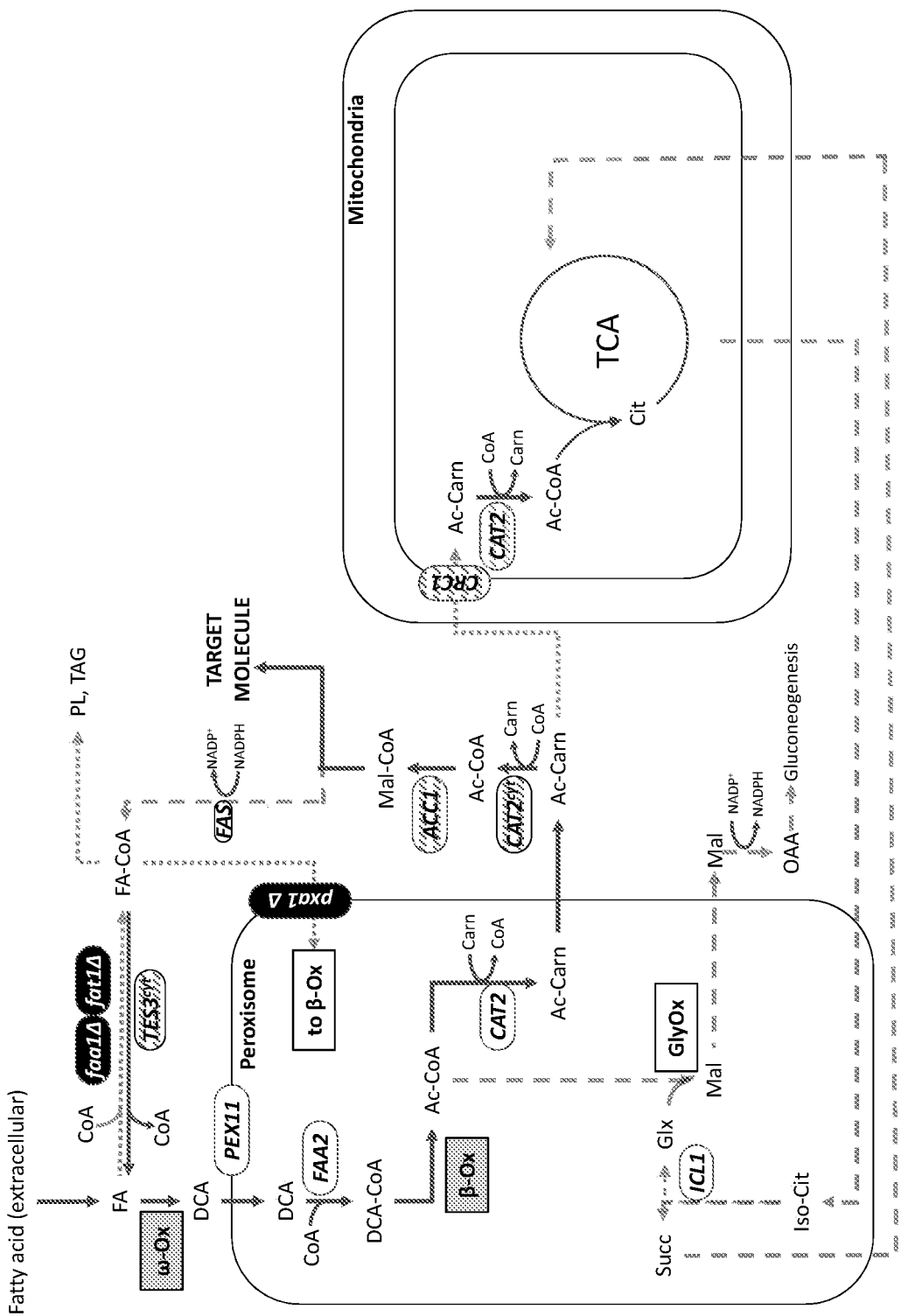

FIG. 8 is a schematic illustration of an engineered carbon flux pathway of a modified cell for use in producing a target molecule. The figure depicts cellular modifications in some embodiments of a eukaryotic (i.e., yeast in this example) platform system for the enhanced production of malonyl-CoA and various target molecules that can be synthesized using malonyl-CoA as a precursor. The details of the modifications in this exemplary engineered platform system are provided in the Detailed Description that follows.

Figure 9:
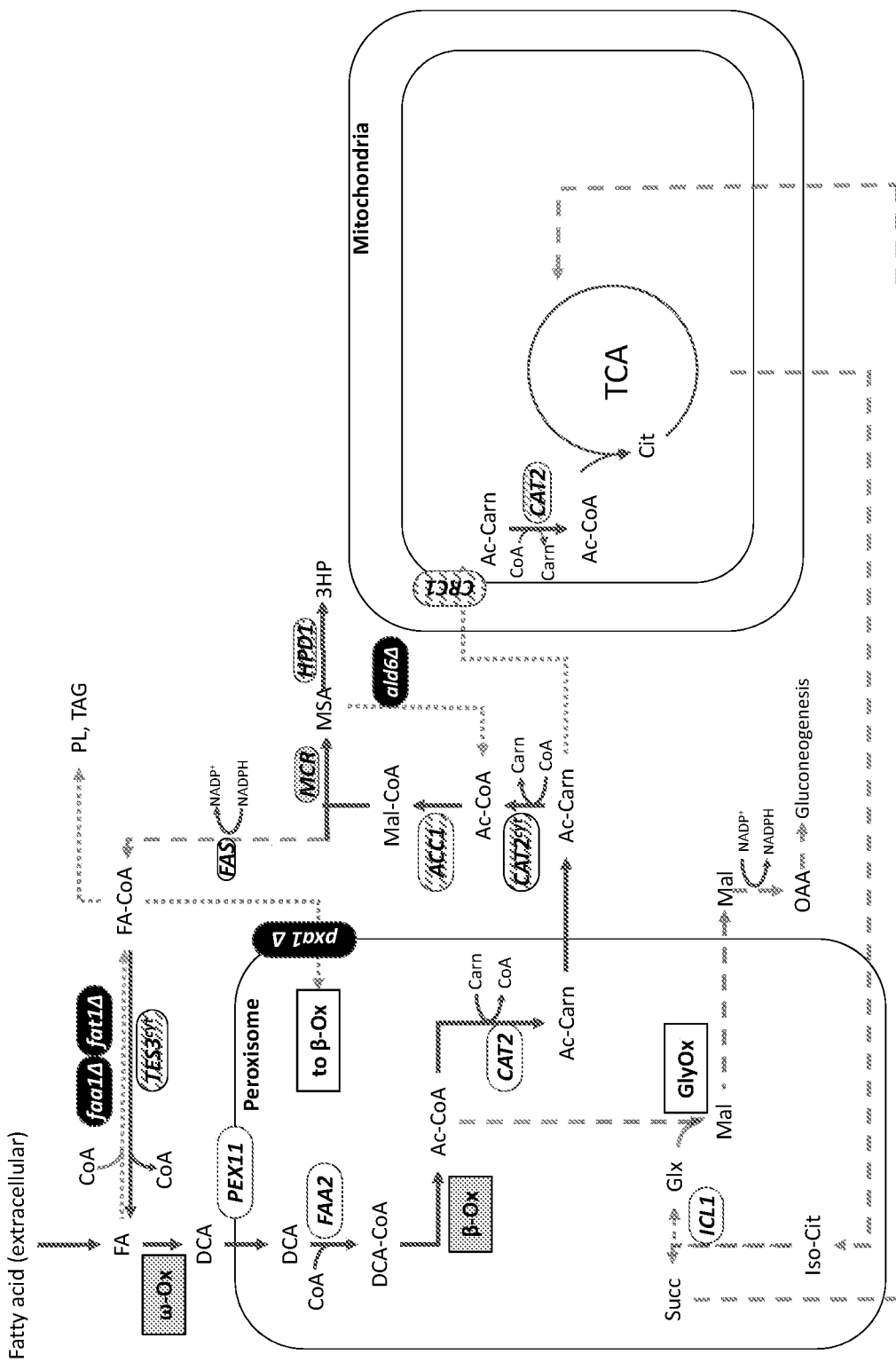

FIG. 9 is a schematic illustration of an example of an engineered production pathway for cell- or microbial-based synthesis of 3-hydroxypropionic acid ("3HP"). Added cytosolic malonyl-CoA reductase ("MCR") activity and modified 3-hydroxy-propionate-dehydrogenase ("HPD1") activities for 3HP synthesis are shown as well as modified (gene deleted) endogenous semialdehyde dehydrogenase ("ald6Δ") activity. The details of the modifications in this exemplary engineered platform system are provided in the Detailed Description that follows.

Figure 10:
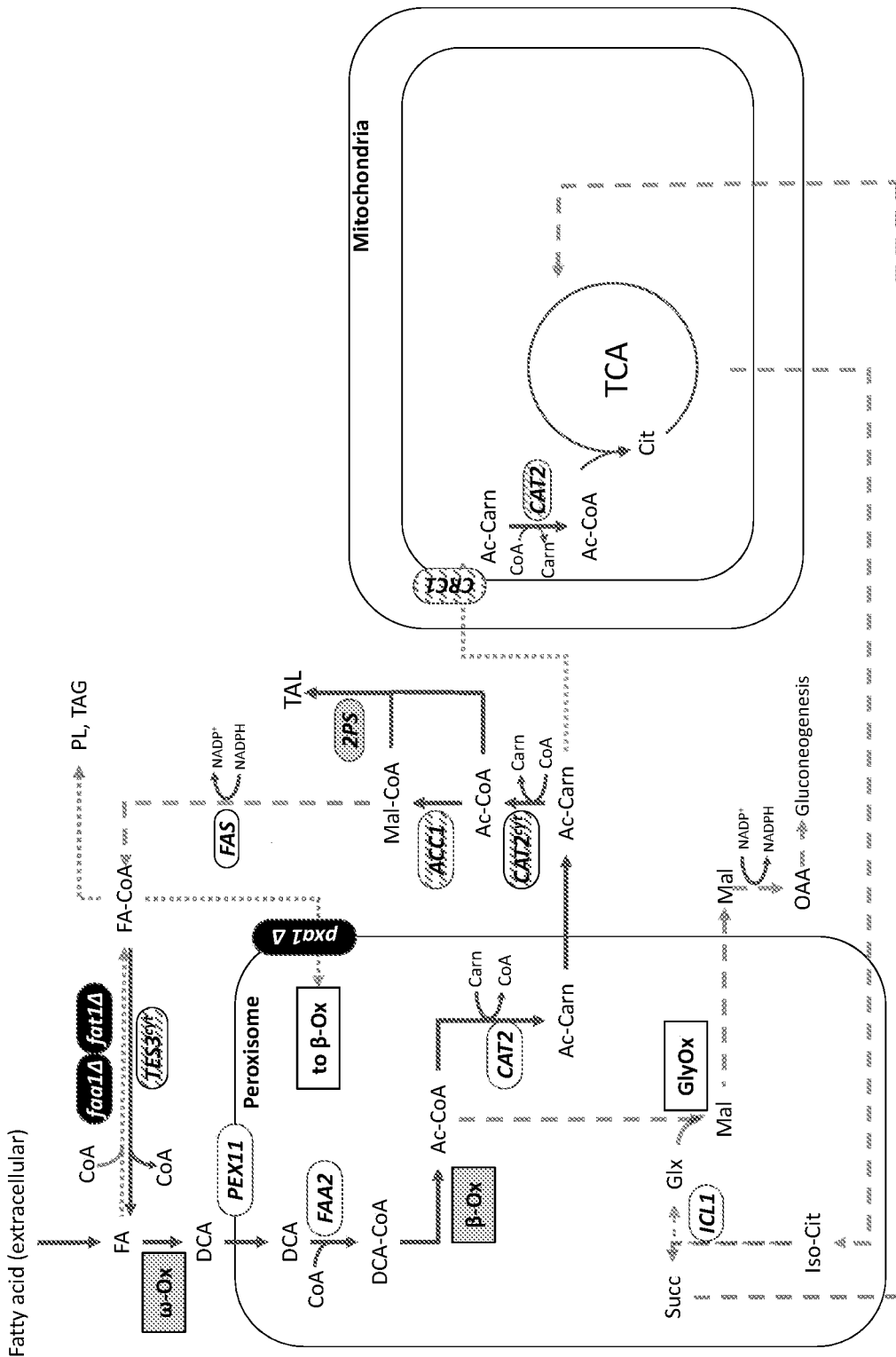

FIG. 10 is a schematic illustration of an example of an engineered production pathway for cell- or microbial-based synthesis of triacetic acid lactone ("TAL"). Added 2-pyrone synthase ("2PS") activity for TAL synthesis is shown. The details of the modifications in this exemplary engineered platform system are provided in the Detailed Description that follows.

Figure 11:
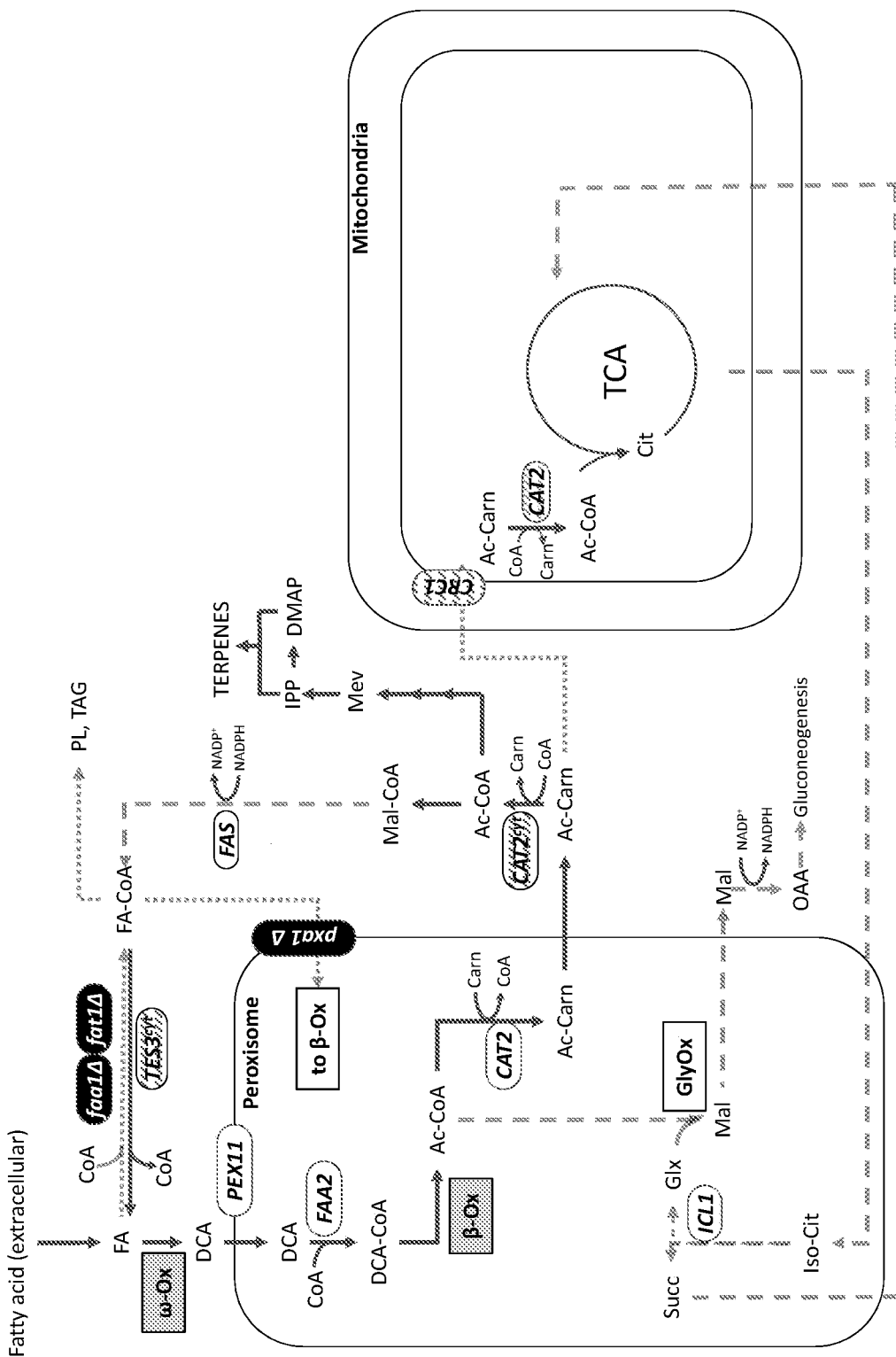

FIG. 11 is a schematic illustration depicting cellular modifications in some embodiments of a eukaryotic (i.e., yeast in this example) platform system for the enhanced generation of acetyl-CoA and the production of a diverse array of target molecules (e.g., terpenes). In one aspect, FIG. 11 differs from FIG. 8 in that it shows an embodiment of the platform system in which target molecule production pathways extend from acetyl-CoA, instead of malonyl-CoA, as a precursor molecule. ("Mev" refers to the mevalonate pathway; "IPP" refers to isopentenyl diphosphate; "DMAPP" refers to dimethylallyl diphosphate.) The details of the modifications in this exemplary engineered platform system are provided in the Detailed Description that follows.

Figure 12:
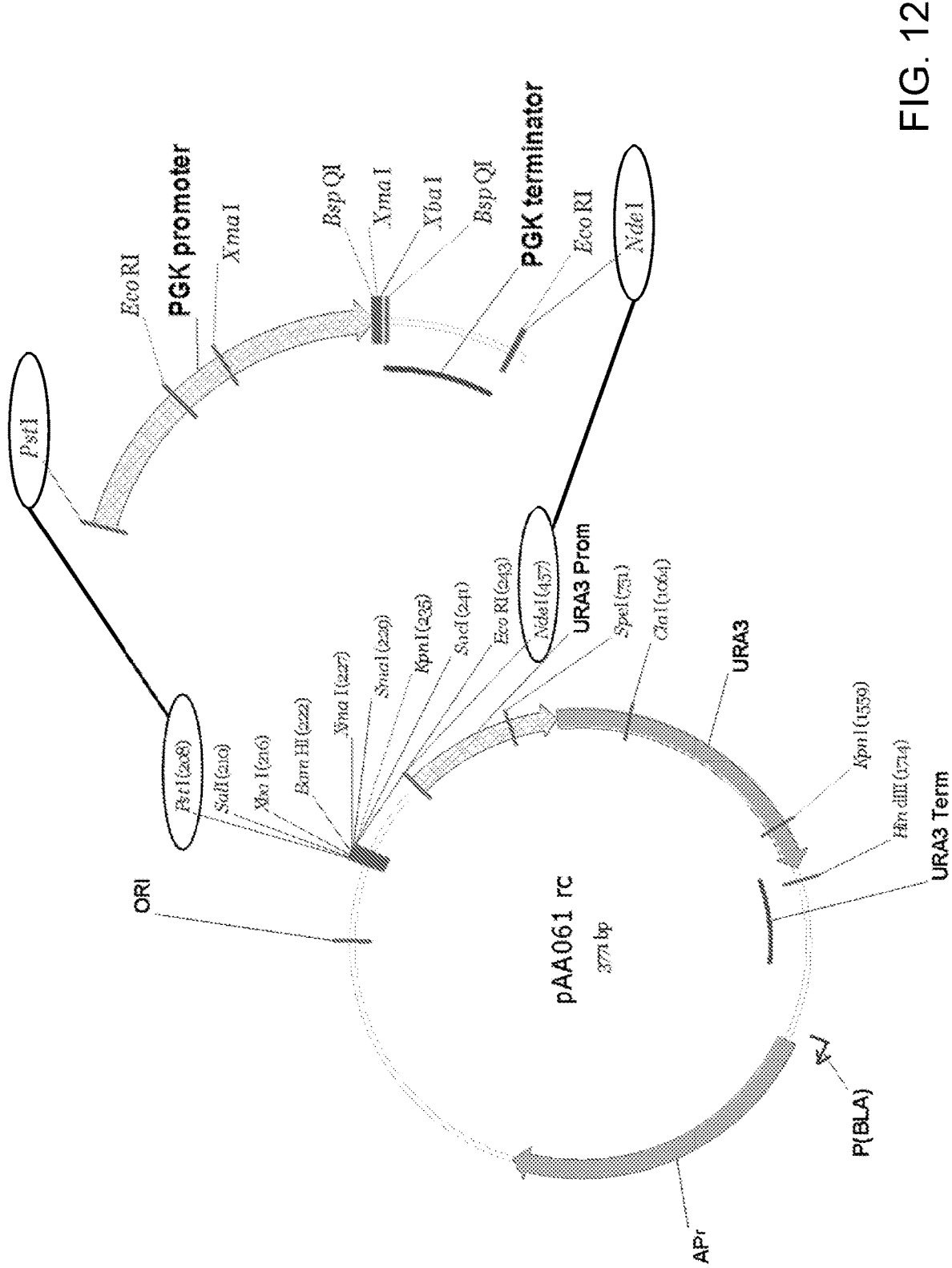

FIG. 12 is a restriction endonuclease site map of plasmid pAA061 showing the relative placement of the following nucleic acid sequences: Candida strain ATCC 20336 orotidine-5'-phosphate decarboxylase (URA3) gene promoter (Prom), open-reading frame and terminator (Term); β-lactamase (ampicillin-resistance) gene promoter (P(BLA)) and ORF (AP$^r$); and the Escherichia coli origin of replication (ORI). Also shown are the Candida strain ATCC 20336 phosphoglycerate kinase (PGK) gene promoter and terminator that were added to pAA061 to form pAA105.

Figure 13:
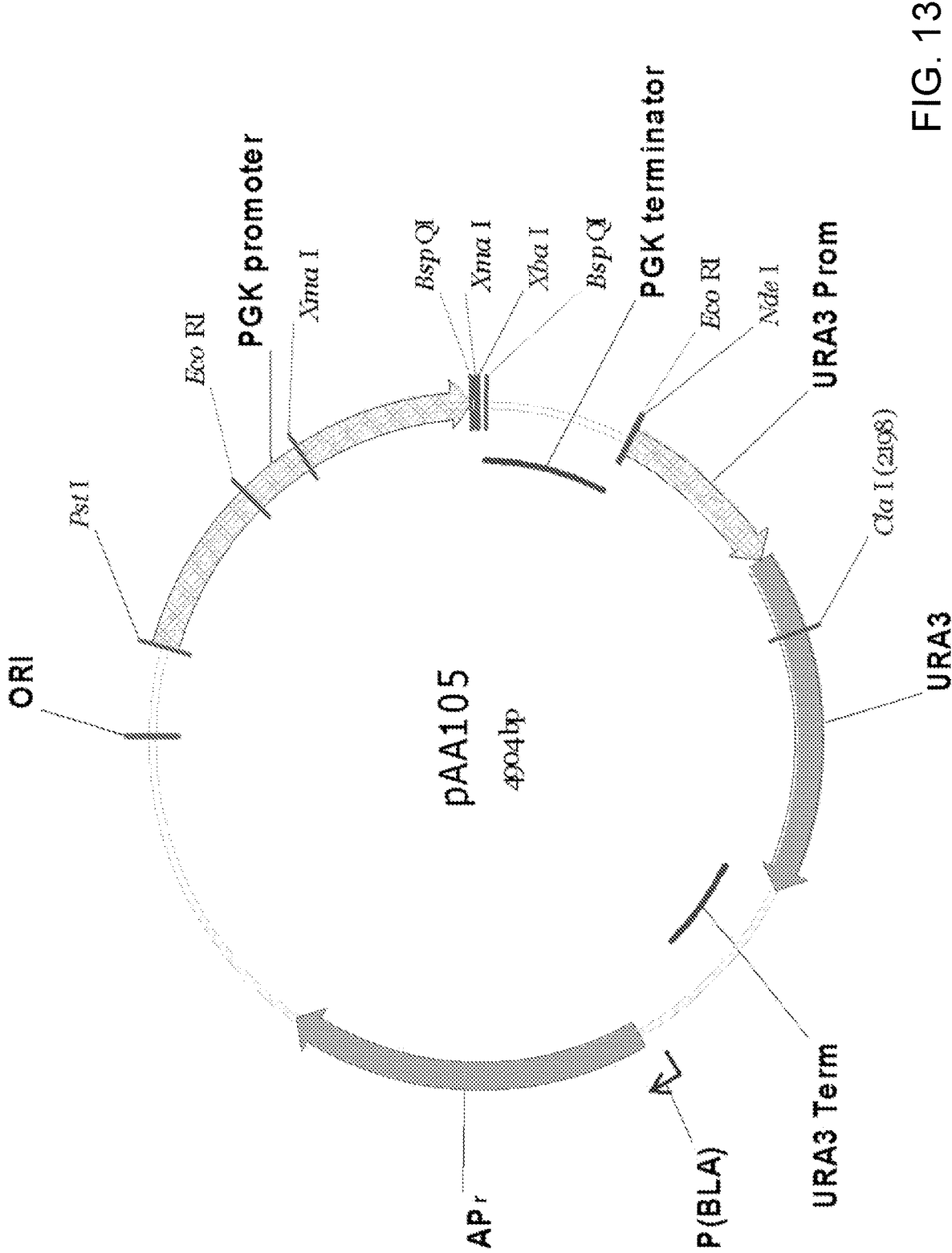

FIG. 13 is a restriction endonuclease site map of plasmid pAA105 which was constructed by ligating the Candida strain ATCC 20336 phosphoglycerate kinase (PGK) gene promoter and terminator with the PstI/NdeI fragment of pAA061 (FIG. 12).

Figure 14:
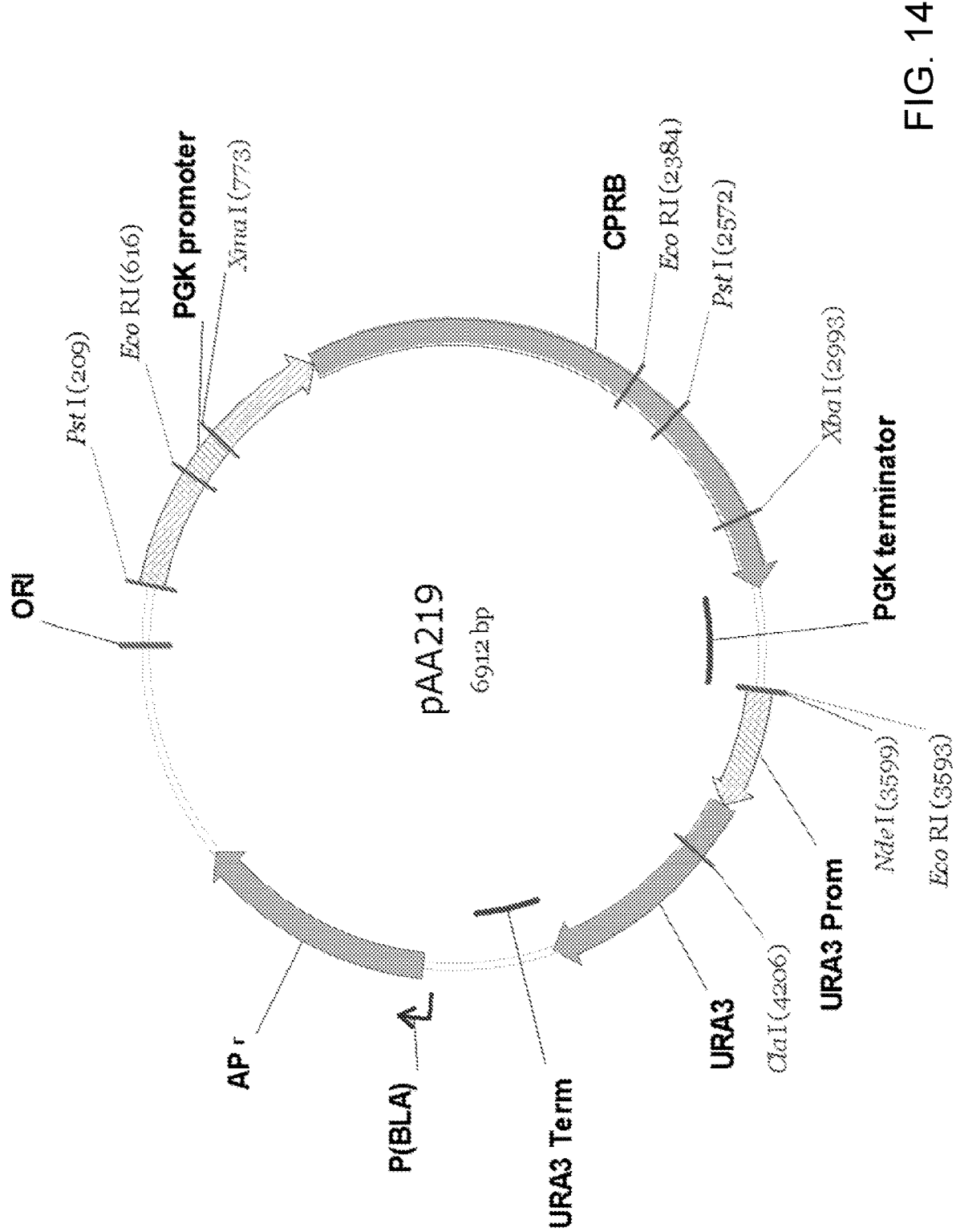

FIG. 14 is a restriction endonuclease site map of plasmid pAA219 which was constructed by inserting the Candida strain ATCC 20336 cytochrome P450 reductase (CPRB) ORF between the PGK gene promoter and terminator in pAA105 (FIG. 13).

Figure 15:
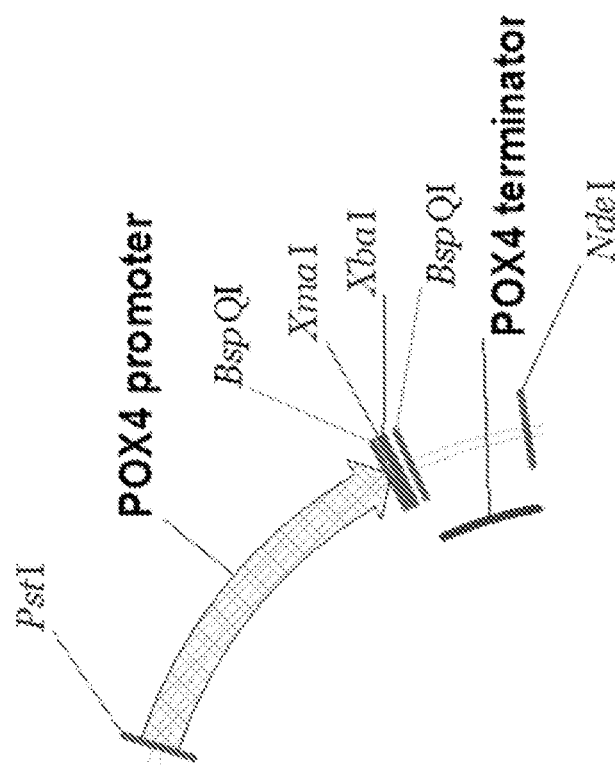

FIG. 15 is a restriction endonuclease site map of a PstI/NdeI fragment of plasmid pAA073 which contains the Candida strain ATCC 20336 acyl-CoA oxidase (POX4) gene promoter and terminator with restriction sites between them for incorporating ORFs to be controlled by the inducible POX4 promoter.

Figure 16:
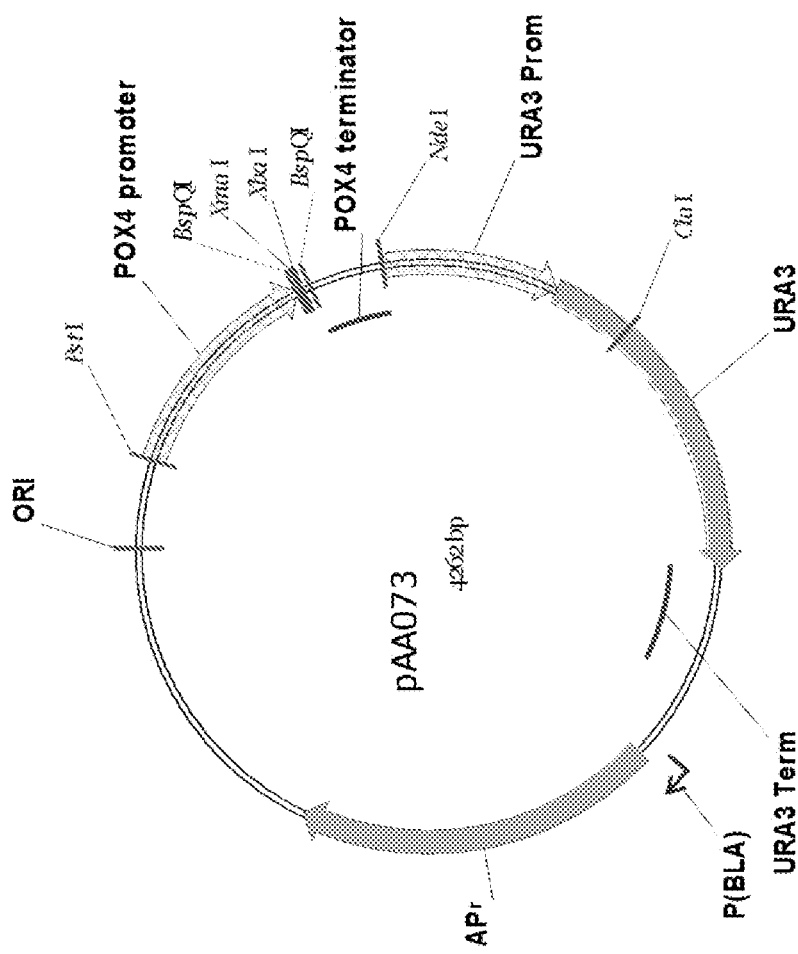

FIG. 16 is a restriction endonuclease site map of a fragment of plasmid pAA073. Plasmid pAA073 was constructed by ligating the PstI/NdeI fragment shown in FIG. 15 with the PstI/NdeI fragment of pAA061 (FIG. 12).

Figure 17:
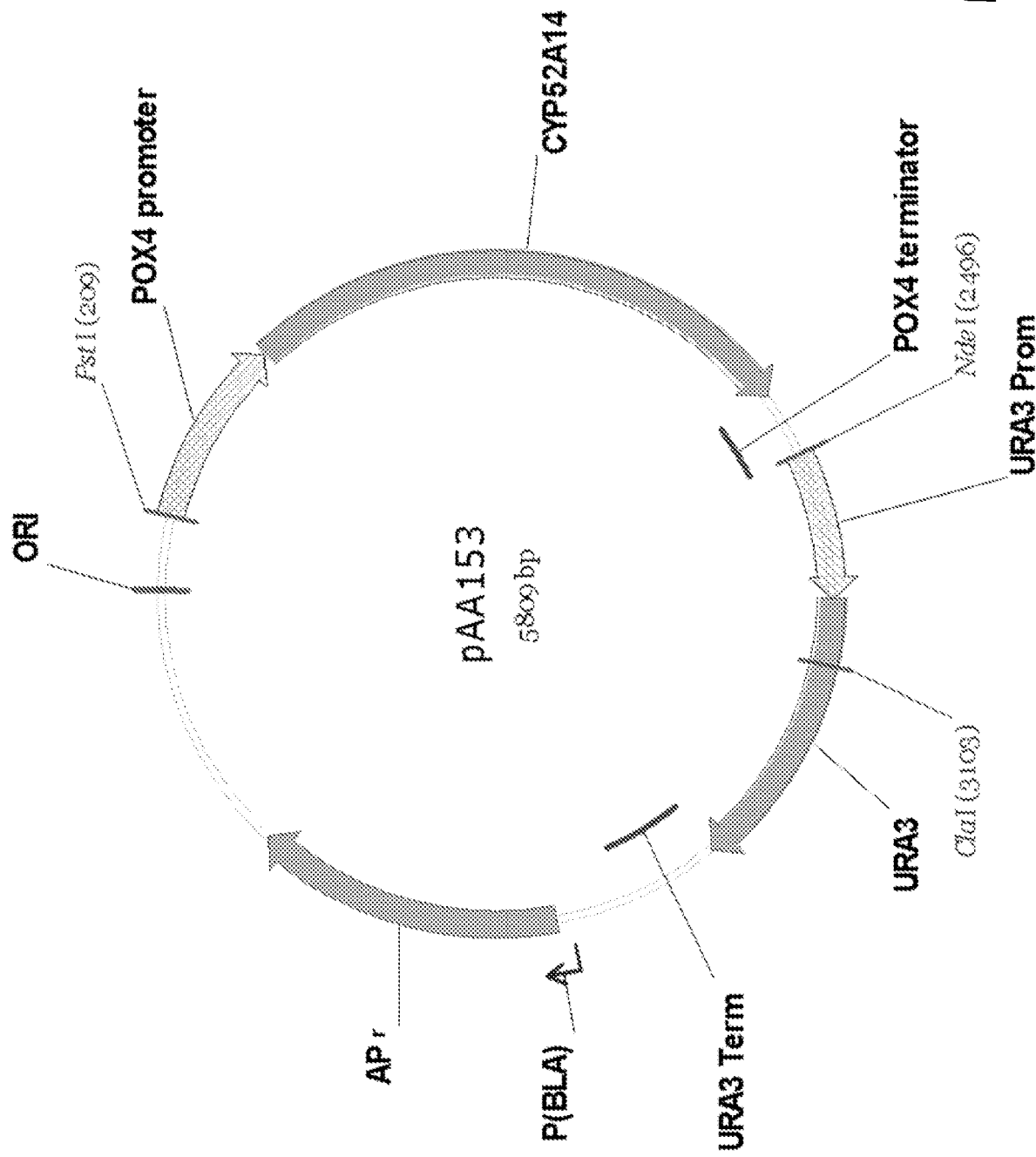

FIG. 17 is a restriction endonuclease site map of plasmid pAA153 which was constructed by inserting the Candida strain ATCC 20336 cytochrome P450 monooxygenase (CYP52A14) ORF between the POX4 gene promoter and terminator in pAA073.

Figure 18:
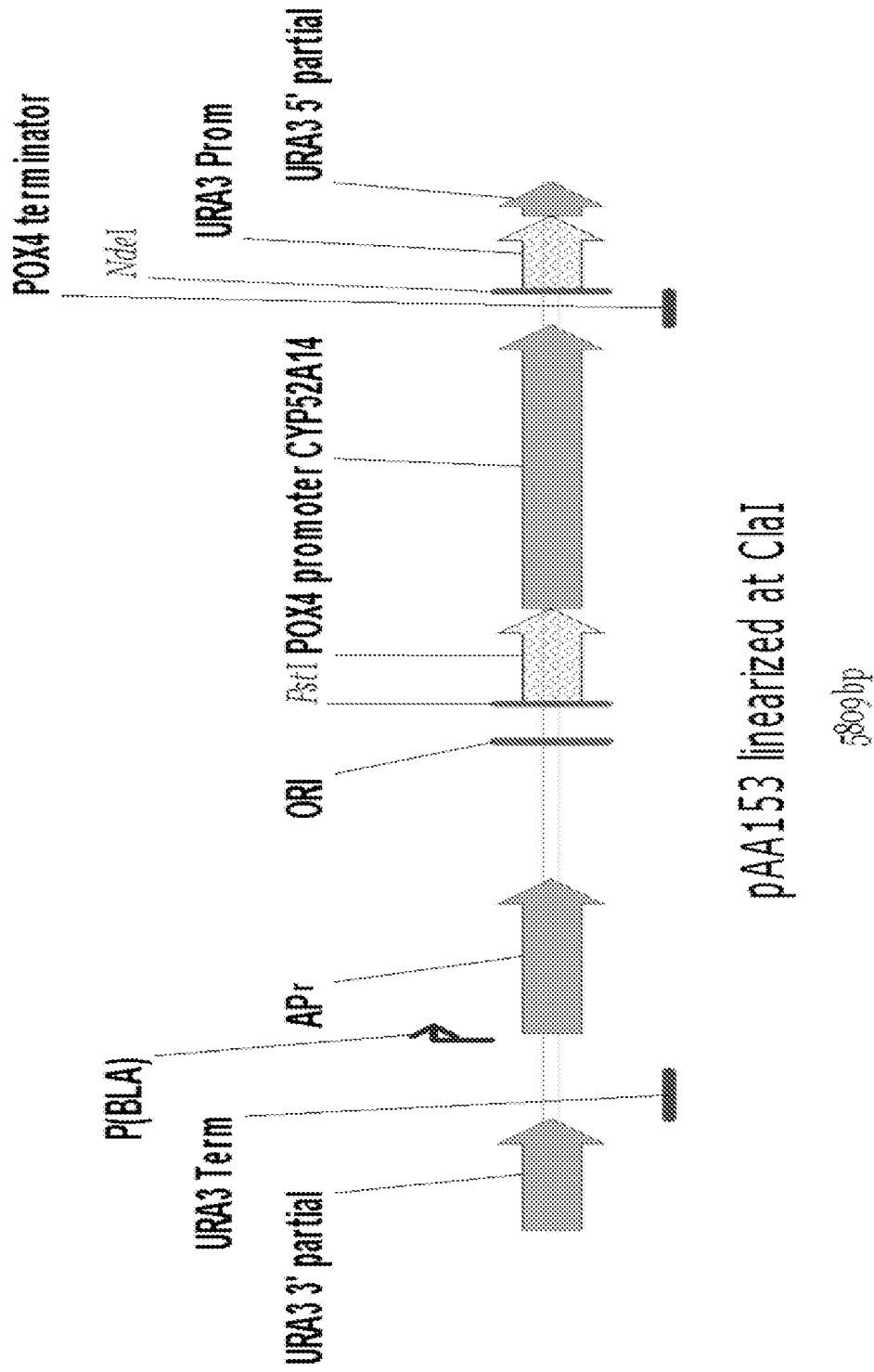

FIG. 18 is a diagrammatic representation of pAA153 (FIG. 17) linearized by endonuclease cutting of the plasmid at the C/al site to yield a cassette for use in the addition of a Candida strain ATCC 20336 CYP52A14 gene into a host non-functional ura3 locus using the single crossover integration method. The core of the cassette contains the CYP52A14 gene with a POX4 promoter and terminator for controlling transcription of the gene. Cutting of the plasmid at the C/al site splits the URA3 selectable marker and yields a linear DNA fragment with the CYP52A14 gene expression cassette positioned between the URA3 promoter (URA3 Prom) and terminator (URA3 Term).

Figure 19:
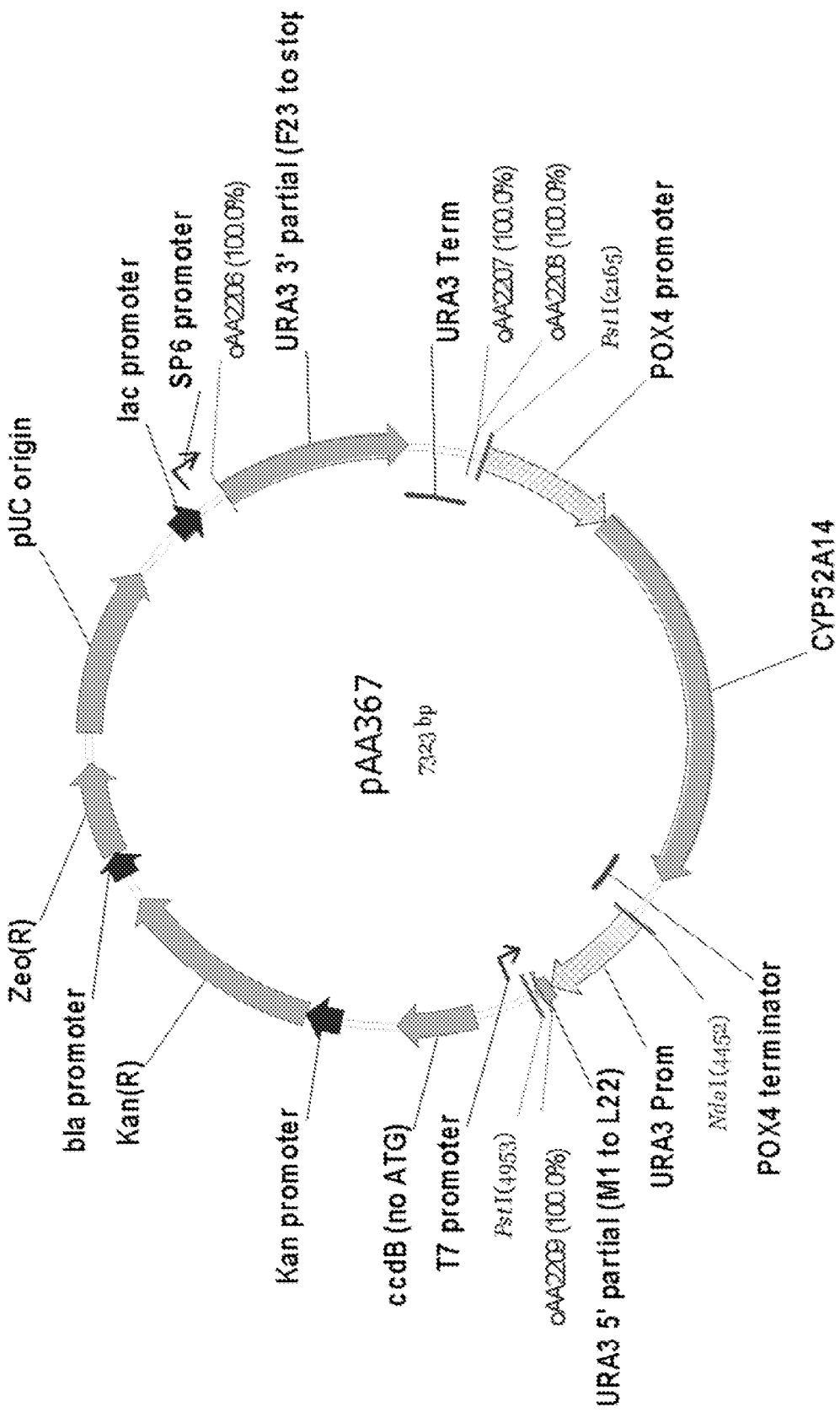

FIG. 19 is a diagrammatic representation of plasmid pAA367 generated by (1) PCR amplification of two separate fragments of pAA153 (FIG. 17), one fragment containing a 3' URA3 sequence and the URA3 terminator and another fragment containing a CYP52A14 gene expression cassette with a POX4 promoter and terminator followed by the URA3 promoter and a 5' URA3 sequence, (2) joining of the two amplicons by overlap extension PCR to generate a single amplified fragment and (3) cloning of the single fragment into pCR-BluntII-TOPO.

Figure 20:
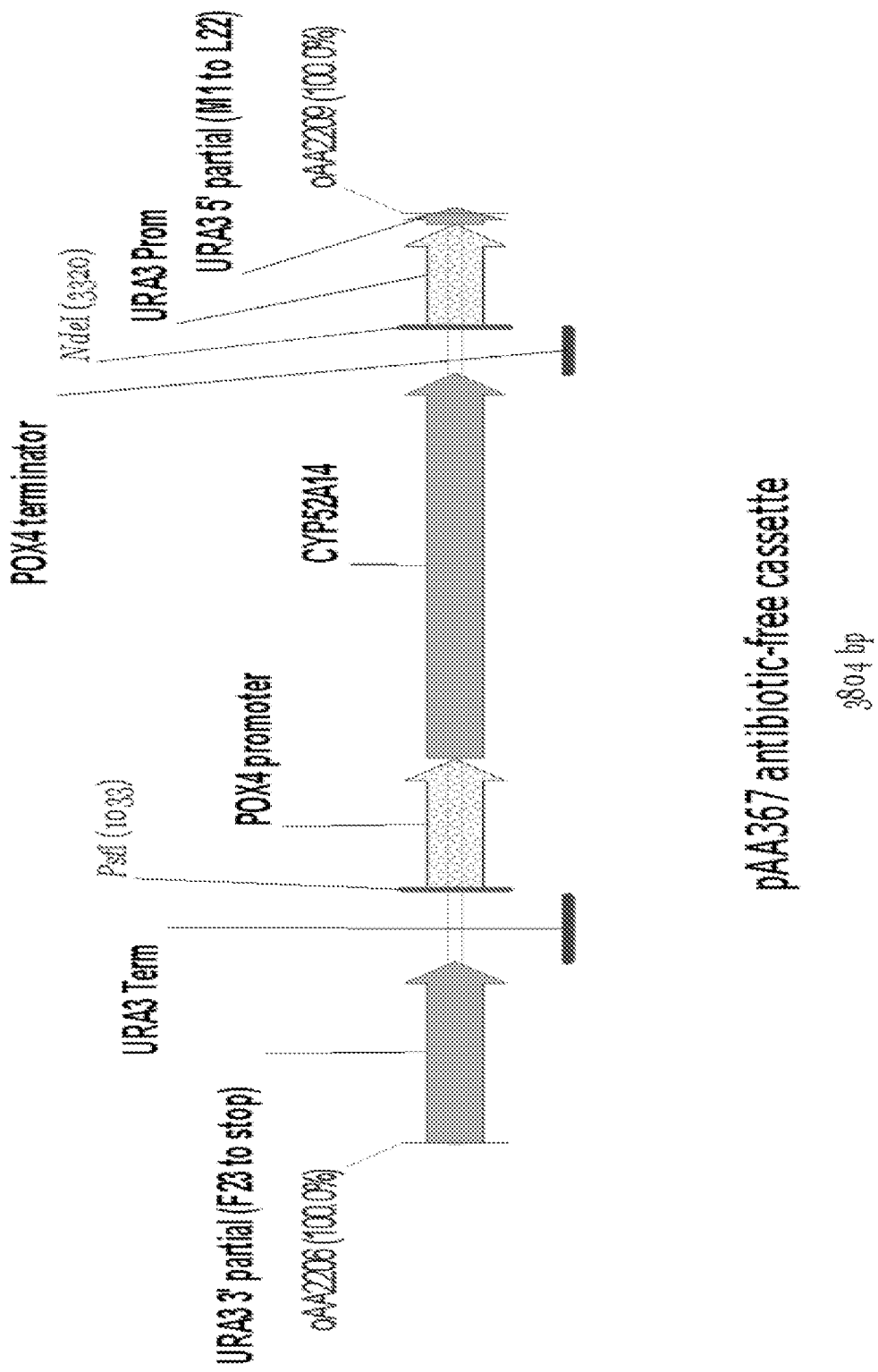

FIG. 20 is a diagrammatic representation of a linear DNA expression cassette obtained by amplification from pAA367 (FIG. 19) that does not contain nucleic acid encoding an antibiotic selection marker (i.e., antibiotic-free).

Figure 21A:
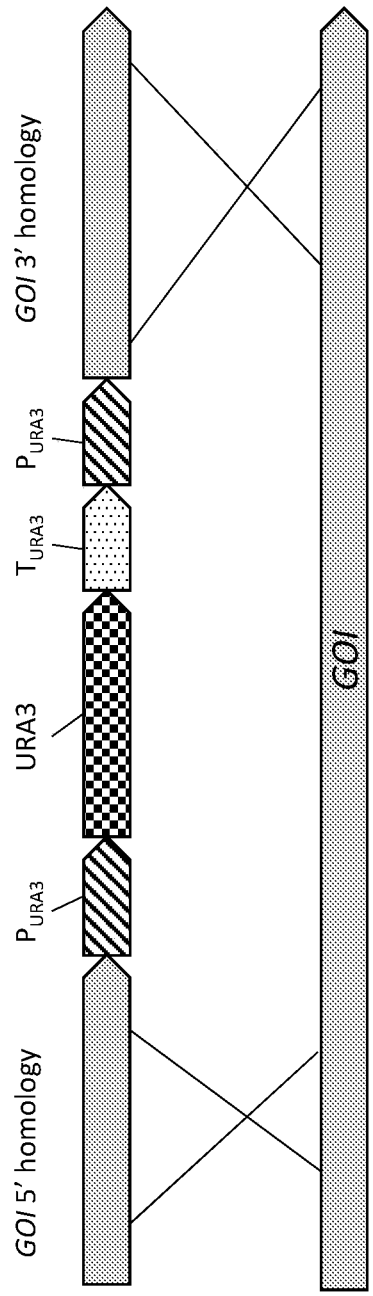
Figure 21B:
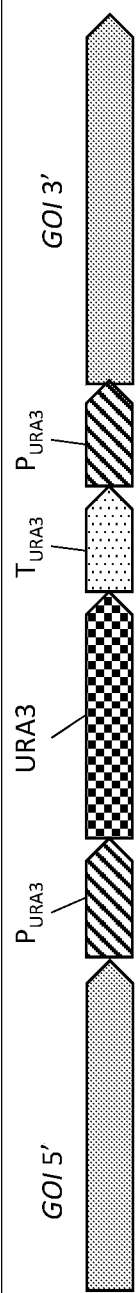
Figure 21C:

FIG. 21A, FIG. 21B, and FIG. 21C show diagrammatic illustrations of a "knock out" gene disruption method which disrupts a target gene ("GOI"). FIG. 21A shows a double-crossover gene knock-out cassette for knocking out the function of a GOI containing a URA3 selectable marker gene (including the gene promoter ($P_{URA3}$) and terminator ($T_{URA3}$)) between 5' and 3' homologous sequences for the GOI. The URA3 selectable marker also has DNA sequence direct repeats ($P_{URA3}$) at the beginning and at the end of the gene sequence. After transformation of the double-crossover gene knock-out cassette into a Ura$^-$ mutant, the URA3 marker allows selection on SC-URA plates for colonies that have integrated the construct (FIG. 21B) disrupting the GOI and generating a Ura$^+$ phenotype. Subsequent growth of Ura transformants on 5-fluoroorotic acid (5-FOA) yields Ura$^-$ cells resulting from removal of the URA3 selectable marker from the genome by a second crossover homologous recombination between the DNA sequence direct repeats ($P_{URA3}$) (FIG. 21C). A DNA sequence direct repeat remains in the genome as a "scar" left behind at the gene knock out site. The URA3 selection marker may now be used again for further genetic modifications.

Figure 22:
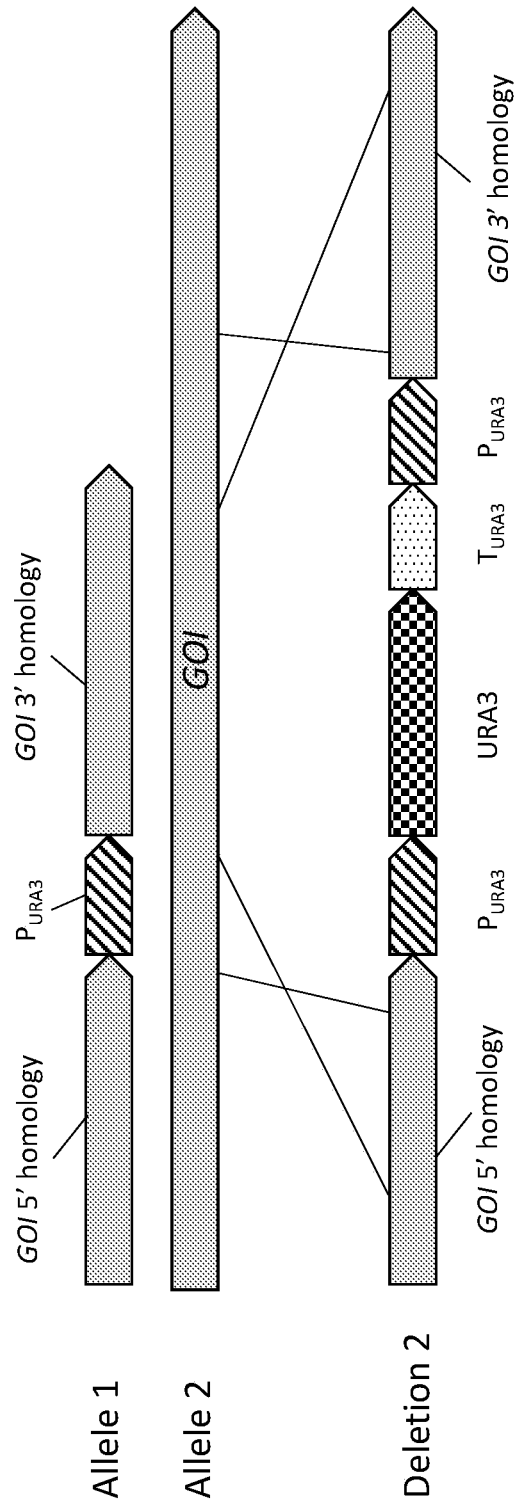

FIG. 22 is a diagrammatic depiction of how the knock out gene disruption method illustrated in FIGS. 21A-21C, which regenerates an auxotrophic (Ura−) cell after the second homologous recombination event, enables the same URA3-based selection method to be used repeatedly on the same cell, for example, such as in the disruption of the second allele ("Deletion 2") of a gene of interest (GOI) following the disruption of the first allele.

Figure 23:
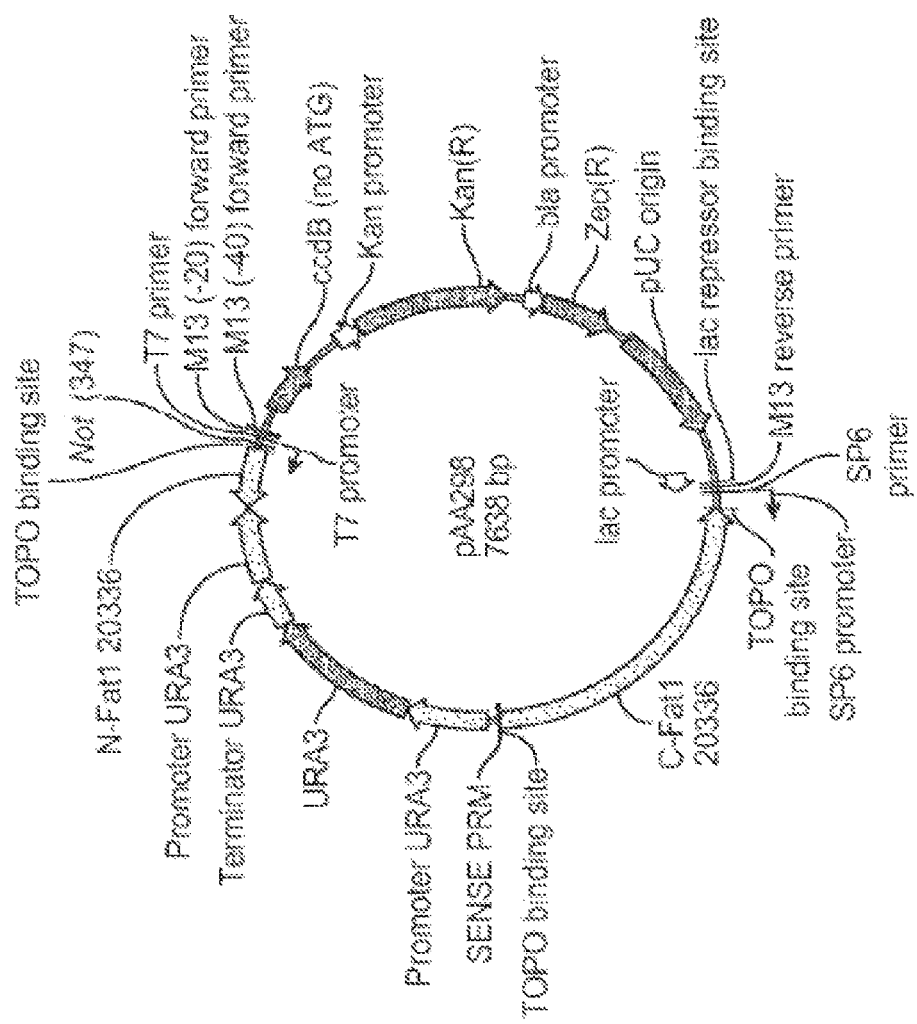

FIG. 23 is a restriction endonuclease site map of plasmid pAA298 containing a double-crossover gene knock-out cassette for knocking out the function of a FAT1 gene. As shown in the figure, the double-crossover gene knock-out cassette includes a URA3 selectable marker gene (including the gene promoter and terminator) between 5' and 3' homologous sequences ("N-Fat1" and "C-Fat1," respectively) for the FAT1 gene. The plasmid also contains elements from pCR-BluntII-TOPO.

Figure 24:
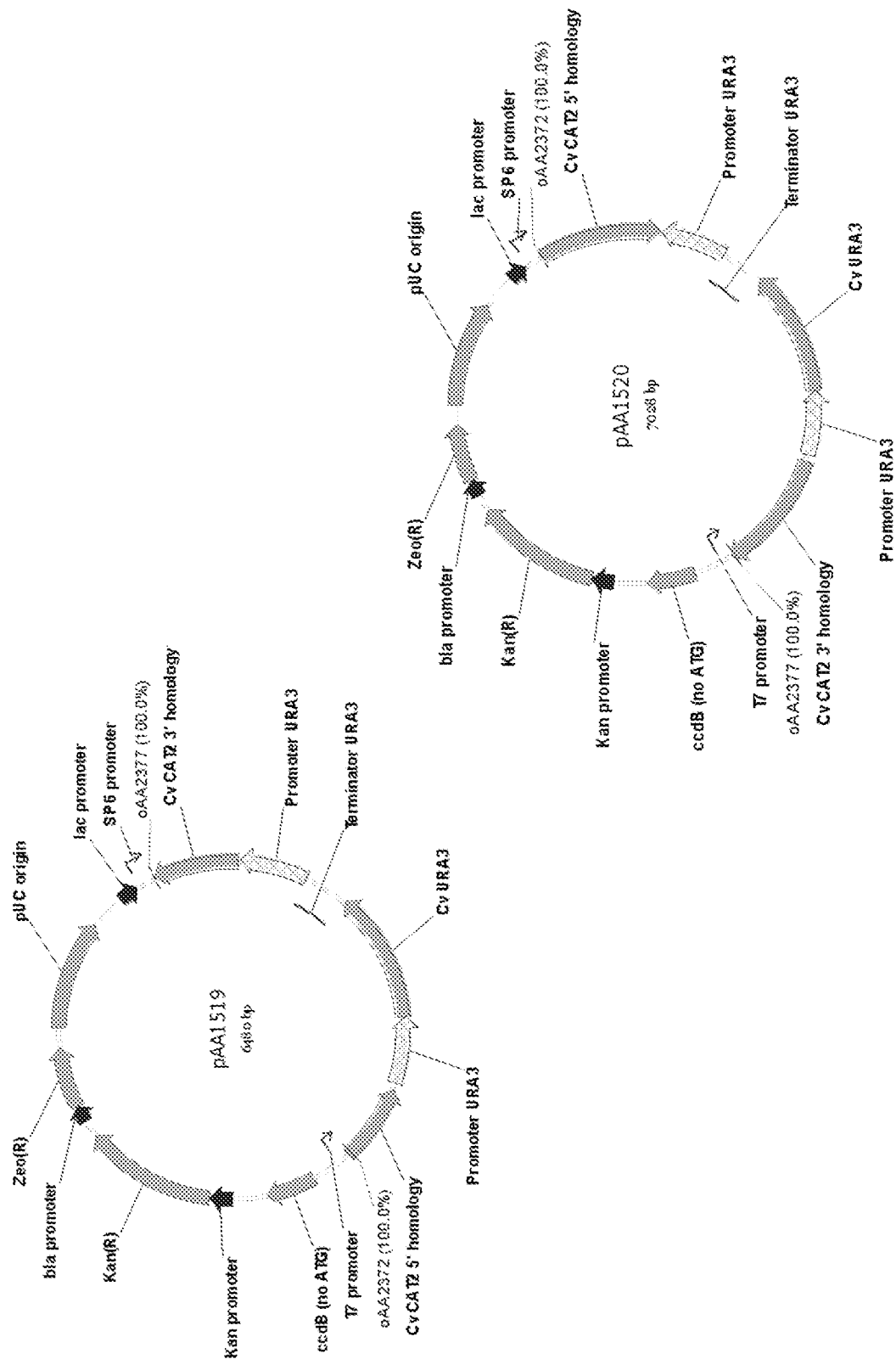

FIG. 24 shows restriction endonuclease site maps of plasmids pAA1519 and pAA1520 each containing a double-crossover gene knock-out cassette for knocking out the function of a CAT2 gene. Each CAT2 gene deletion cassette includes a 5' Candida viswanathii strain ATCC 20336 CAT2 DNA fragment ("Cv CAT2 5' homology"), a 3' Candida viswanathii strain ATCC 20336 CAT2 DNA fragment ("Cv CAT2 3' homology") and a Candida viswanathii strain ATCC 20336 URA3 gene fragment containing a URA3 ORF ("Cv URA3"), URA3 promoter and a URA3 terminator followed by a repeat of the promoter. The gene knock-out cassettes are contained within pCR-BluntII-TOPO.

FIG. 25A and FIG. 25B show a comparison of the N-terminal (FIG. 25A) and C-terminal (FIG. 25B) amino acid sequences of an unmodified Candida strain ATCC 20336 carnitine acetyltransferase ("Cv-CAT2 from pAA426") protein and of modified carnitine acetyltransferase proteins lacking one or both of the N-terminal mitochondrial targeting sequence (mts) and the C-terminal peroxisomal targeting sequence (pts). ("Cv-CAT2(-mts)" refers to the protein lacking only an N-terminal mitochondrial targeting sequence; "Cv-CAT2(-pts)" refers to the protein lacking only a C-terminal peroxisomal targeting sequence; "Cv-CAT2(-mts-pts)" refers to the protein lacking the N-terminal mitochondrial targeting sequence and the C-terminal peroxisomal targeting sequence.)

Figure 26:
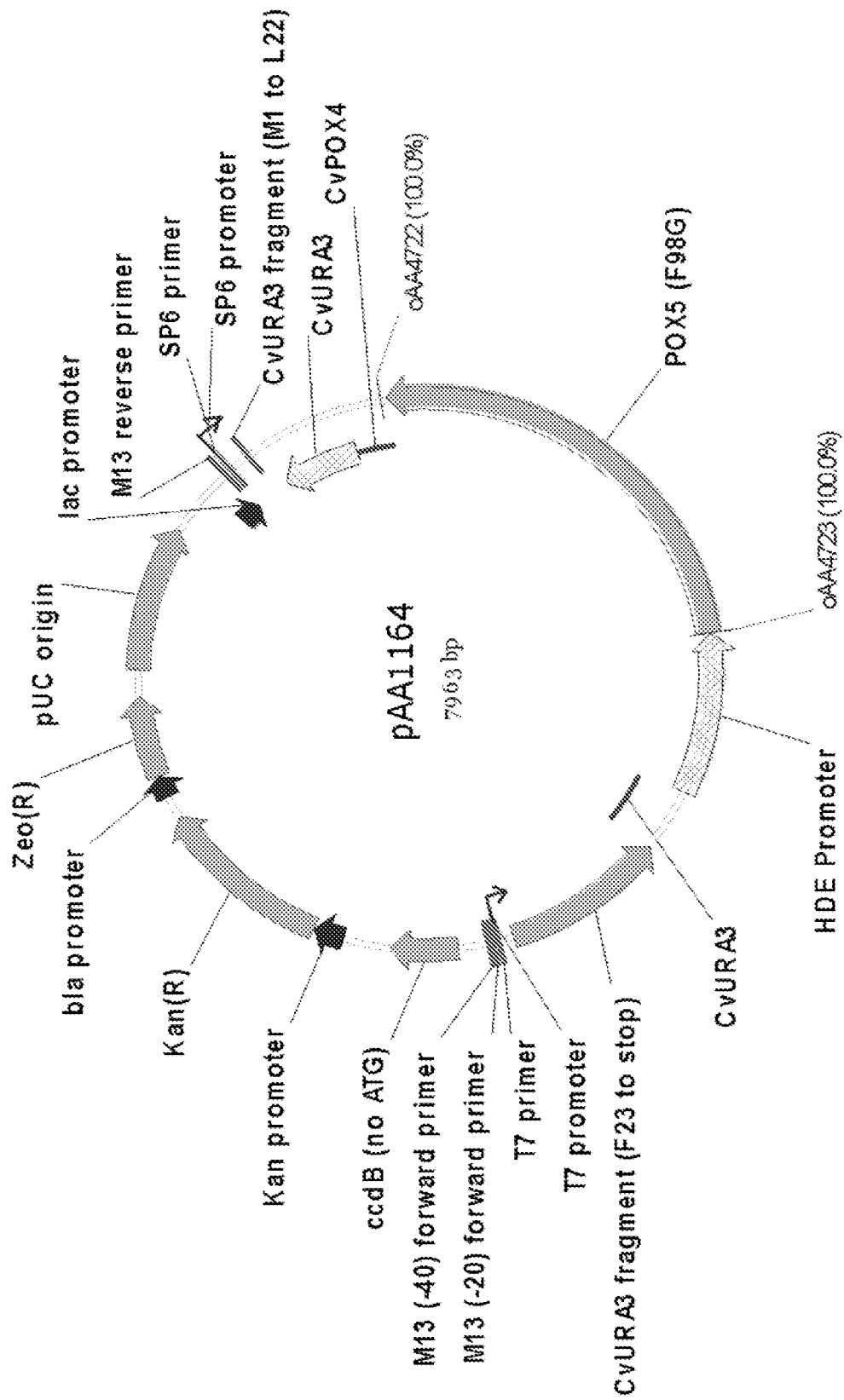

FIG. 26 is a map of plasmid pAA1164 containing all the elements of the pCR-BluntII-TOPO vector, two separate portions of a URA3 gene selectable marker originally cloned from Candida strain ATCC 20336, nucleic acid encoding a modified Candida strain ATCC 20336 Pox5p (i.e., Pox5 (F98G)) and the HDE gene promoter and POX4 gene terminator, both from Candida strain ATCC 20336. Also shown are the locations of sequences corresponding to oligonucleotides oAA4722 and oAA4723 which were used as primers in PCR amplification of the larger fragment sequence between these two sites. The amplified DNA fragment was used in the construction of pAA1610 (see details provided in the Examples herein). The "CvURA3" segment positioned following the 3' URA3 fragment ("CvURA3 F23 to Stop") corresponds to the URA3 terminator, whereas the "CvURA3" segment positioned in front of the 5' URA3 fragment ("CvURA3 M1 to L22") corresponds to the URA3 promoter.

FIG. 27 shows a comparison of the N-terminal amino acid sequences of an unmodified Candida strain ATCC 20336 cytosolic carnitine acetyltransferase ("Cv-Yat1p") protein and of modified Yat1p carnitine acetyltransferase proteins containing an added N-terminal mitochondrial targeting sequence (mts) in place of the initiating methionine of the unmodified Yat1p. ("Cv-Yat1p+CAT2mts" refers to the protein with an added N-terminal mitochondrial targeting sequence from the Candida strain ATCC 20336 mitochondrial carnitine acetyltransferase; "Cv-Yat1p+CIT1mts" refers to the protein with an added N-terminal mitochondrial targeting sequence from the Candida strain ATCC 20336 citrate synthase; "Cv-Yat1p+COX4mts" refers to the protein with an added N-terminal mitochondrial targeting sequence from the Candida strain ATCC 20336 cytochrome c oxidase.)

Figure 28:
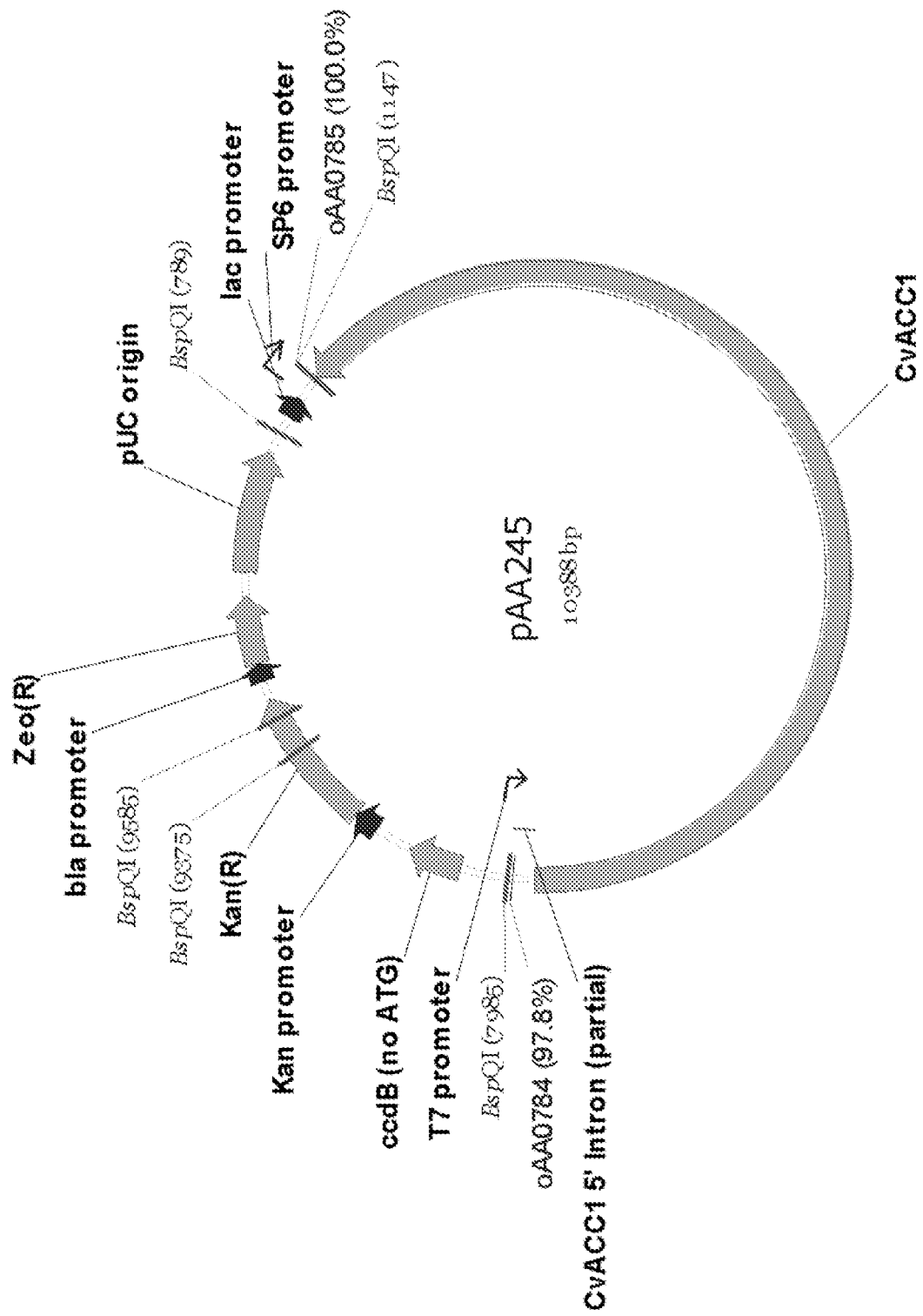

FIG. 28 is a restriction endonuclease site map of plasmid pAA245 which contains all the elements of the pCR-BluntII-TOPO vector, DNA encoding a Candida strain ATCC 20336 acetyl-CoA carboxylase ("CvACC1") enzyme and a 5' partial intron ("CvACC1 5' Intron partial") at the 5' end of the ACC1 ORF. Also shown are the locations of sequences corresponding to oligonucleotides oAA0784 and oAA0785 which can be used as primers in PCR amplification of the Acc1-encoding DNA fragment from genomic DNA.

Figure 29:
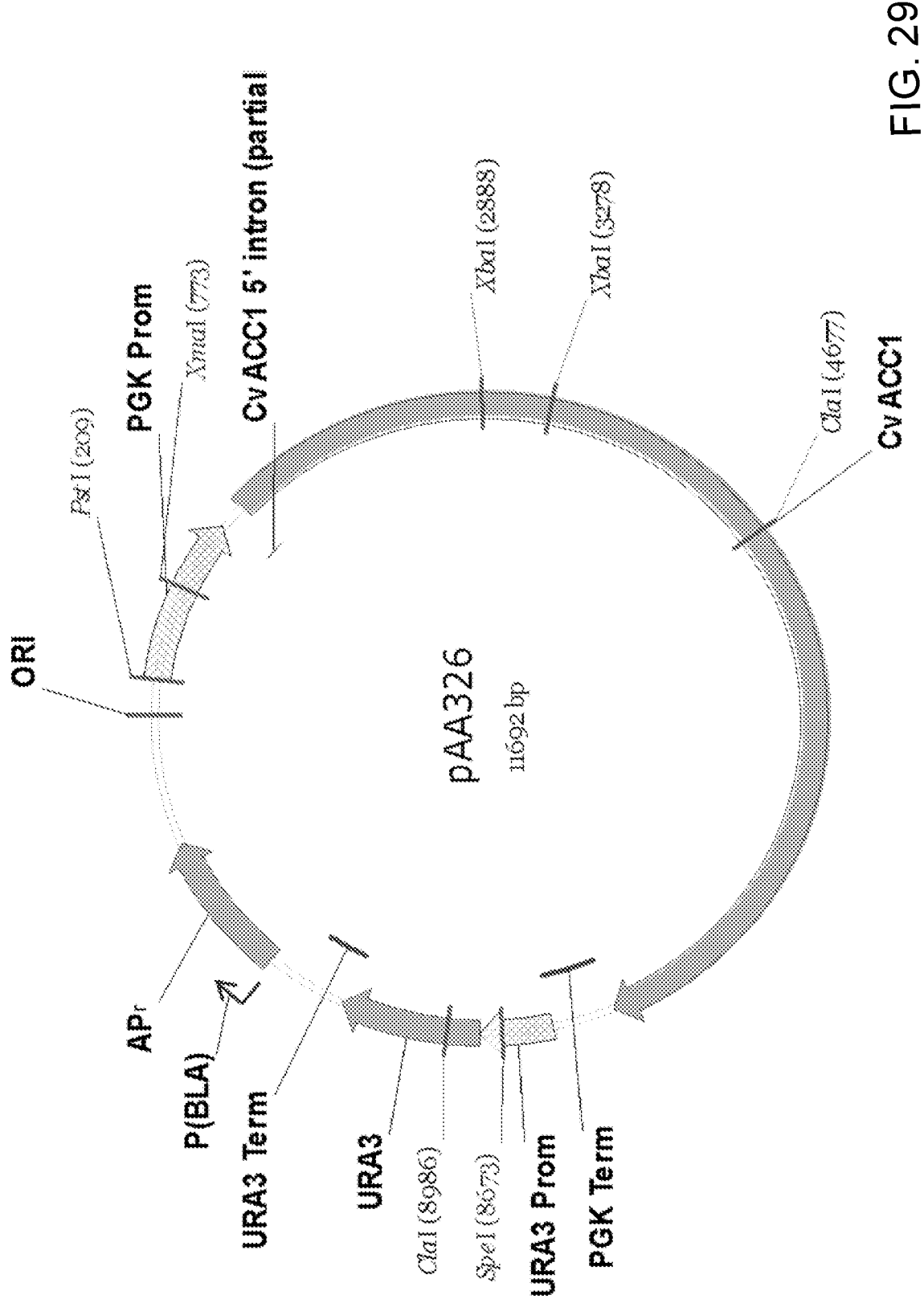

FIG. 29 is a restriction endonuclease site map of plasmid pAA326 which was generated by cutting pAA245 (FIG. 28) with BspQI and ligating the resulting ACC1 gene fragment including 5' partial intron into BspQI-cut plasmid pAA105 (FIG. 13) to put the gene under the control of the PGK promoter and terminator from Candida strain ATCC 20336.

Figure 30:
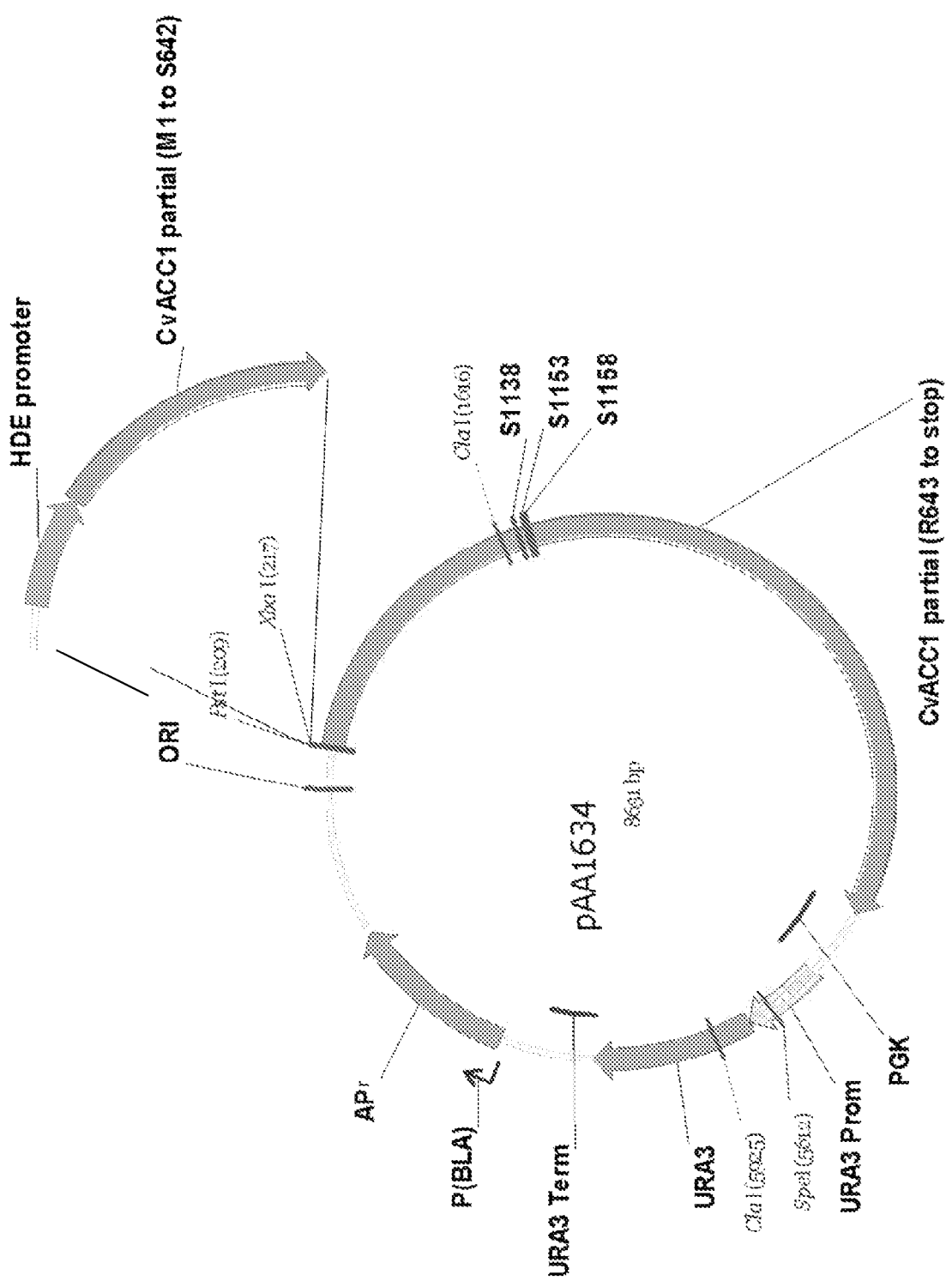

FIG. 30 is a restriction endonuclease site map of plasmid pAA1634 generated by ligating a SpeI/XbaI fragment of pAA326 (FIG. 29) containing DNA encoding amino acids R643 to the STOP codon of Candida strain ATCC 20336 ACC1 with SpeI/XbaI-digested pAA601 (FIG. 12). A series of site-directed mutagenesis reactions was performed on pAA1634 to introduce mutations into the truncated ACC1 coding sequence as described in the Examples herein. Also shown in the figure is an illustration of two DNA fragments, one containing an HDE gene promoter and one containing DNA encoding amino acids M1-S642 of the Acc1p (both from Candida strain ATCC 20336) that were subsequently ligated with pAA1634 to generate plasmids containing DNA encoding full-length mutant Acc1p.

Figure 31:
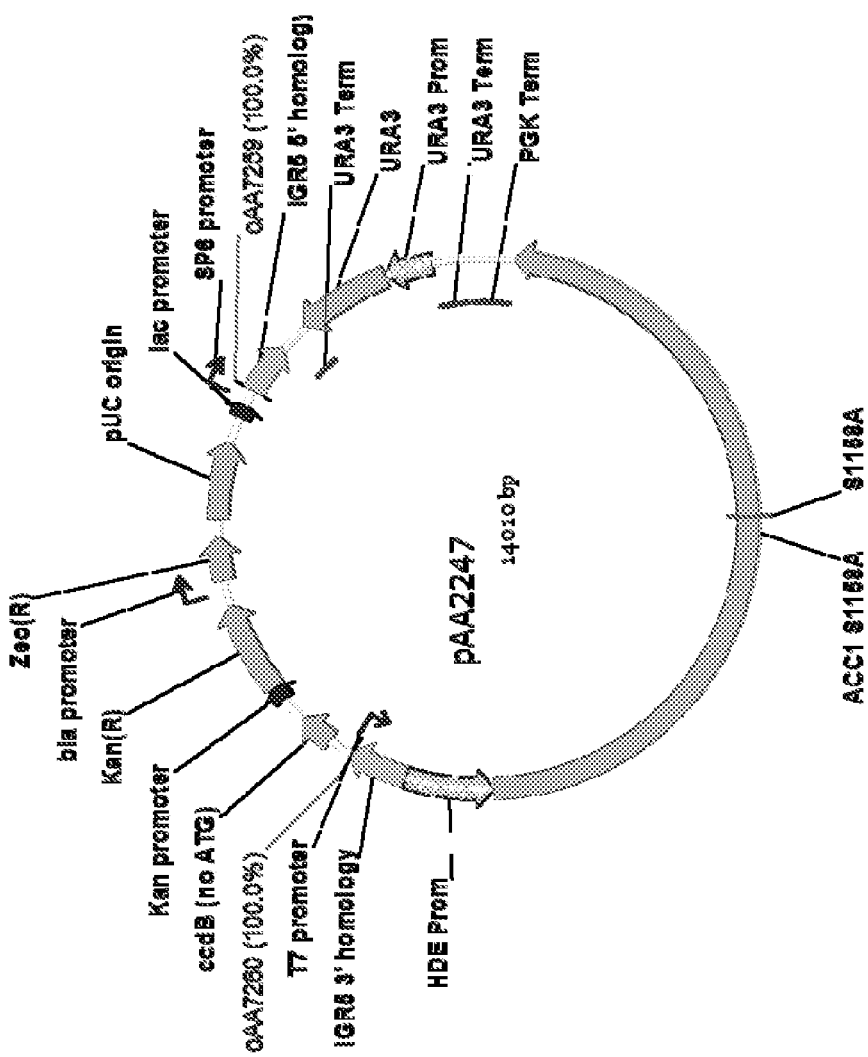

FIG. 31 is a map of plasmid pAA2247 which was generated by ligating a SbfI/MluI fragment of plasmid pAA1908 containing DNA encoding a Candida strain ATCC 20336 Acc1p mutant (S1158A) surrounded by the HDE gene promoter ("Prom") and PGK gene terminator ("Term") from Candida strain ATCC 20336 with SbfI/MluI-digested plasmid pAA2153. Plasmid pAA2153 contains DNA encoding a Candida strain ATCC 20336 URA3 selectable marker with a direct repeat of the $T_{URA3}$ sequence located just upstream of the URA3 gene promoter sequence ($P_{URA3}$) to yield $T_{URA3}$-$P_{URA3}$-URA3-$T_{URA3}$. The URA3 selectable marker in pAA2153 is placed between genomic DNA sequence elements ("IGR5 5' homology" and "IGR5 3' homology") from Candida strain ATCC 20336 which are named IGR5. The IGR5 homology regions target integration of the intervening DNA into genomic DNA by homologous recombination. Also shown are the locations of DNA corresponding to primers oAA7259 and oAA7260 which can be used to amplify pAA2247 to generate a linear DNA for transformation of host cells.

Figure 32:
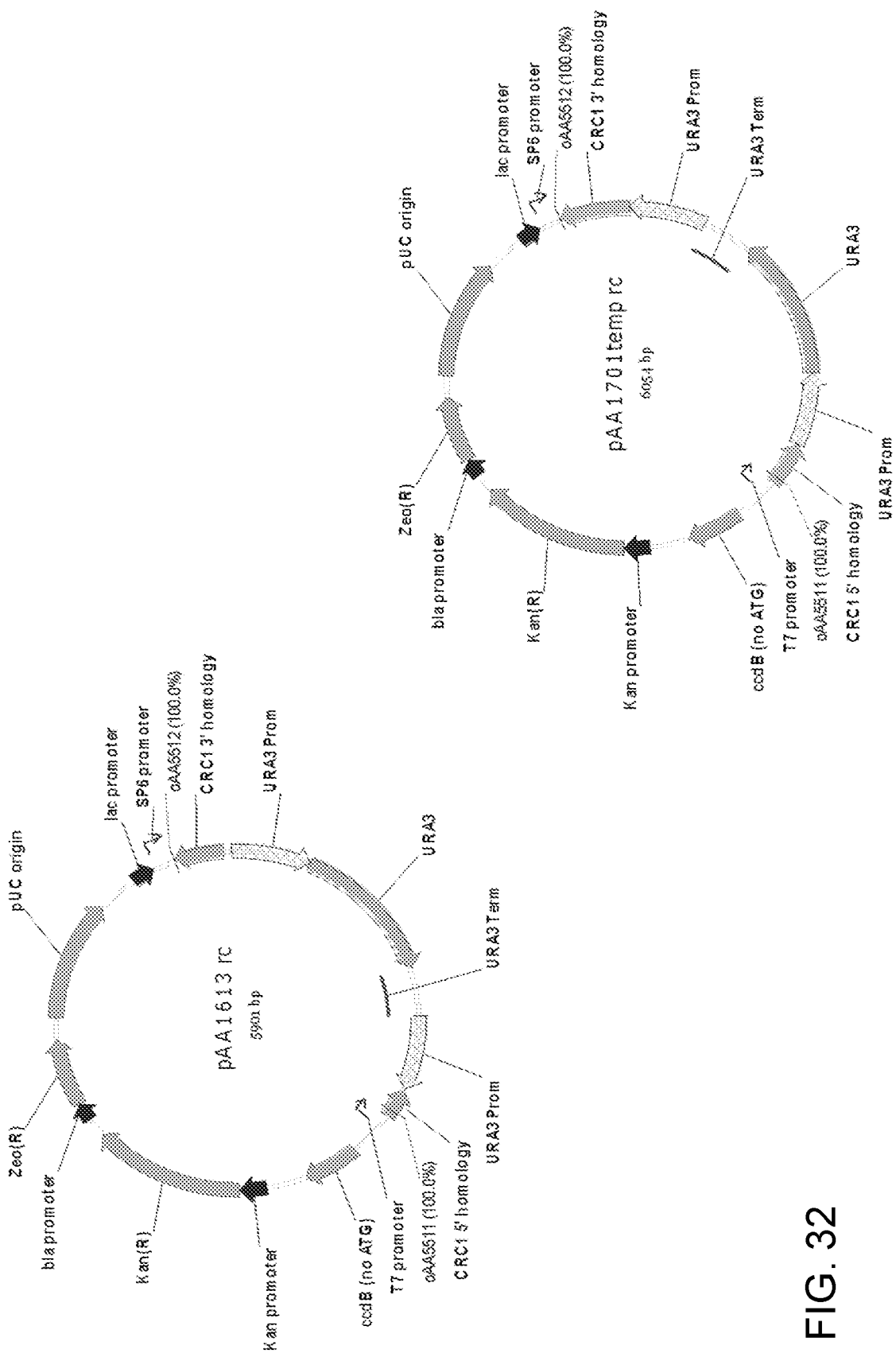

FIG. 32 shows maps of plasmids pAA1613 and pAA1701 which contain double-crossover *Candida* strain ATCC 20336 CRC1 gene knock-out cassettes that can be used to disrupt *Candida* CRC1 genes. The cassette in each plasmid contains a 5' *Candida* strain ATCC 20336 CRC1 DNA fragment ("CRC1 5' homology"), a 3' *Candida* strain ATCC 20336 CRC1 DNA fragment ("CRC1 3' homology") and a *Candida* strain ATCC 20336 URA3 gene fragment containing a URA3 promoter, URA3 ORF, and a URA3 terminator followed by a repeat of the URA3 promoter. The cassettes in the two plasmids differ in the sizes of the CRC1 gene homology regions and the orientation of the URA3 selectable marker between the homology regions. The gene knock-out cassettes are contained within pCR-BluntII-TOPO. Also shown are the locations of DNA corresponding to primers oAA5511 and oAA5512 which can be used to PCR amplify linear cassettes from each plasmid to generate a linear DNA for transformation of host cells.

Figure 33:
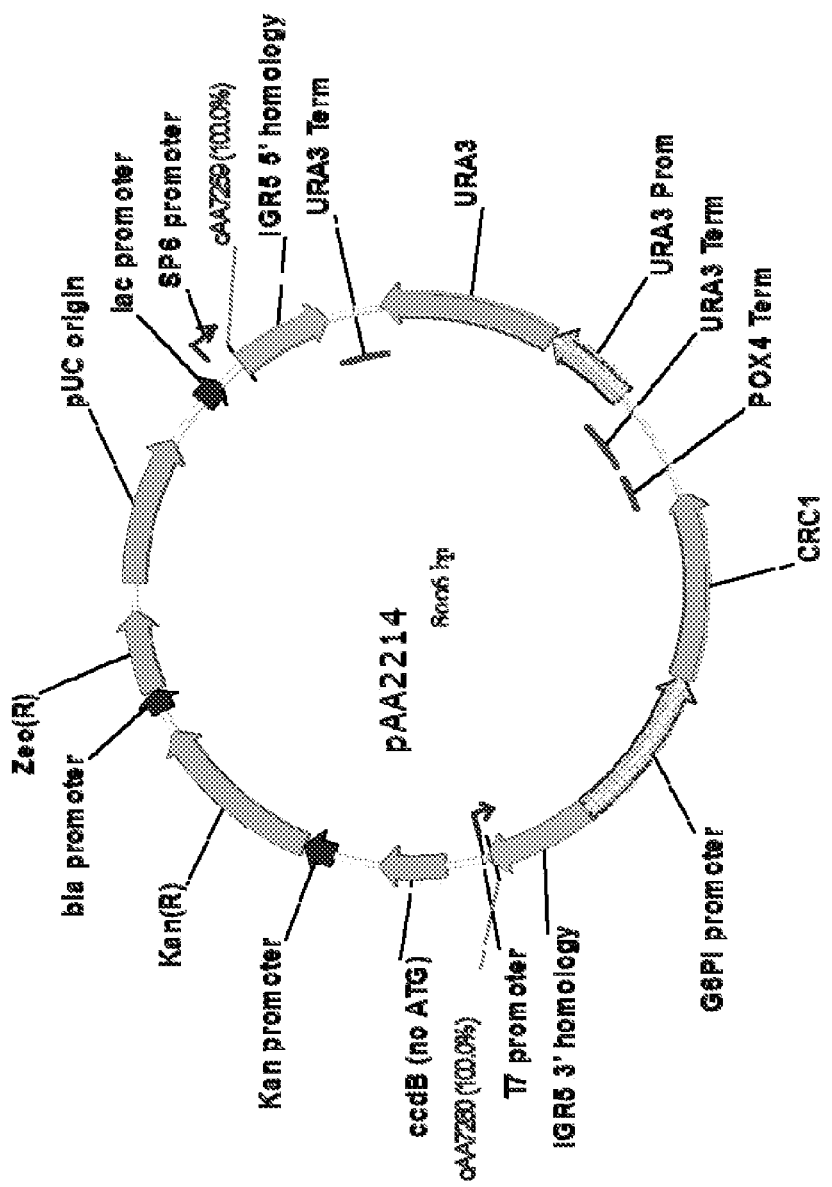

FIG. 33 is a map of plasmid pAA2214 which was generated by ligating a plasmid backbone containing the IGR5 homology regions and URA3 selectable marker (with $T_{URA3}$ repeat) amplified from plasmid pAA2247 (FIG. 31) with a 1,816-bp DNA fragment containing a *Candida* strain ATCC 20336 modified CRC1 gene expression cassette. The expression cassette contains the glucose-6-phosphate isomerase (G6PI) promoter and POX4 gene terminator from ATCC 20336 for controlling expression of the Crc1p. Also shown are the locations of DNA corresponding to primers oAA7259 and oAA7260 which can be used to PCR amplify a linear cassette from pAA2214 to generate a linear DNA for transformation of host cells.

Figure 34:
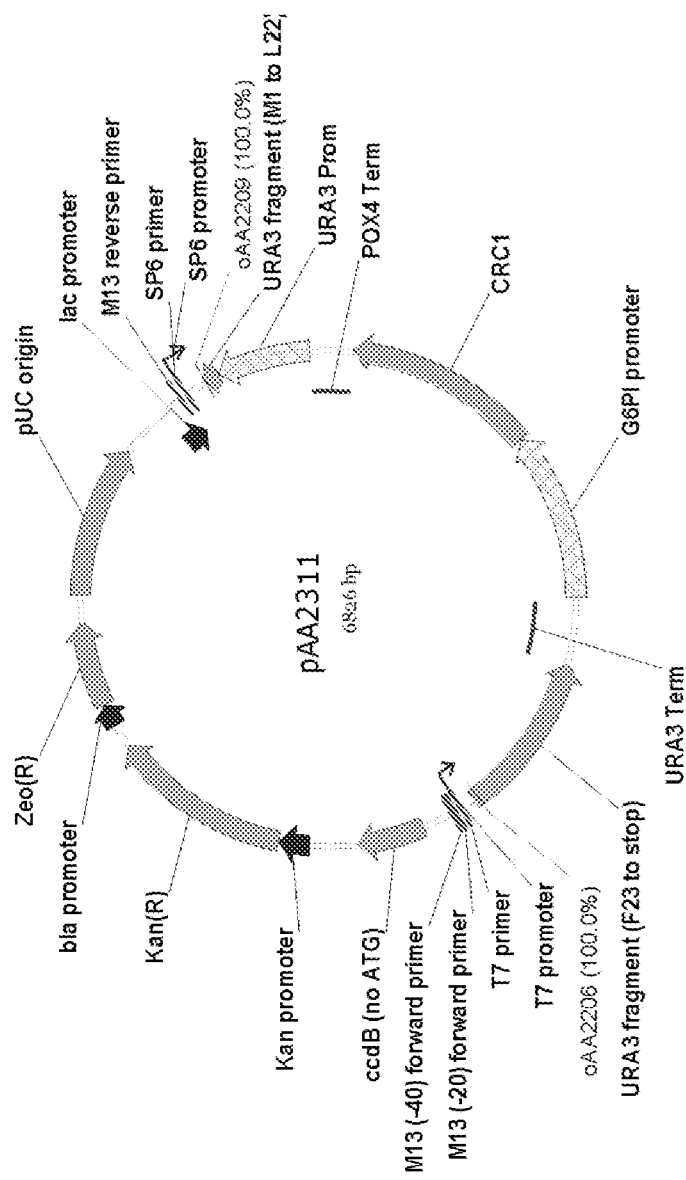

FIG. 34 is a map of plasmid pAA2311 which contains a single-crossover cassette with nucleic acid encoding a *Candida* strain ATCC 20336 CRC1 gene protein linked to a *Candida* strain ATCC 20336 G6PI low-expression promoter. The CRC1 expression elements, $P_{G6PI}$-CRC1-$T_{POX4}$, were obtained as a DNA fragment amplified from plasmid pAA2214 (FIG. 33). This fragment was ligated with a fragment amplified from pAA1164 (FIG. 26) containing all the elements of the pCR-BluntII-TOPO vector, two separate portions of a URA3 selectable marker and a POX4 gene terminator to yield pAA2311. Also shown are the locations of sequences corresponding to oligonucleotides oAA2206 and oAA2209 which can be used as primers in PCR amplification of a 3,307-bp linear, antibiotic-free DNA fragment for use in transforming host cells for expression of the Crc1p.

Figure 35:
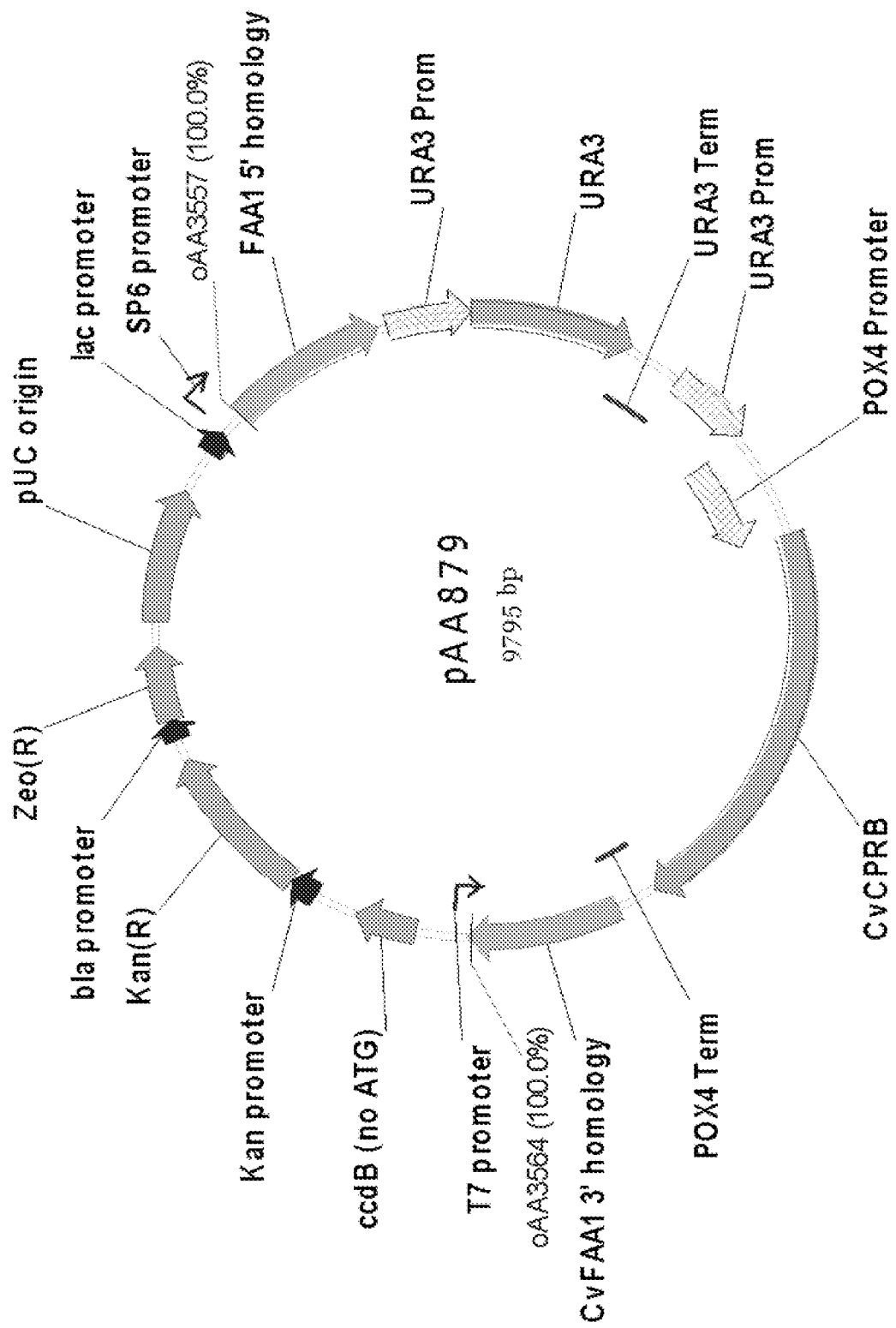

FIG. 35 is a map of plasmid pAA879 which contains a double-crossover knock-in cassette with nucleic acid encoding a *Candida* strain ATCC 20336 cytochrome P450 reductase (CPRB) gene protein. The plasmid contains all the elements of the pCR-BluntII-TOPO vector, two separate portions ("FAA1 5' homology" and "CvFAA1 3' homology") of a *Candida* strain ATCC 20336 FAA1 gene, elements for the expression of CprB protein ("POX4 Promoter," "CvCPRB" and "POX4 term") and a URA3 selectable marker with $P_{URA3}$ repeat (URA3 Prom-URA3-URA3 Term-URA3 Prom). Also shown are the locations of sequences corresponding to oligonucleotides oAA3557 and oAA3564 which can be used as primers in PCR amplification of a linear DNA fragment for use in transforming host cells for disruption of the FAA1 gene and expression of CPRB protein.

Figure 36:
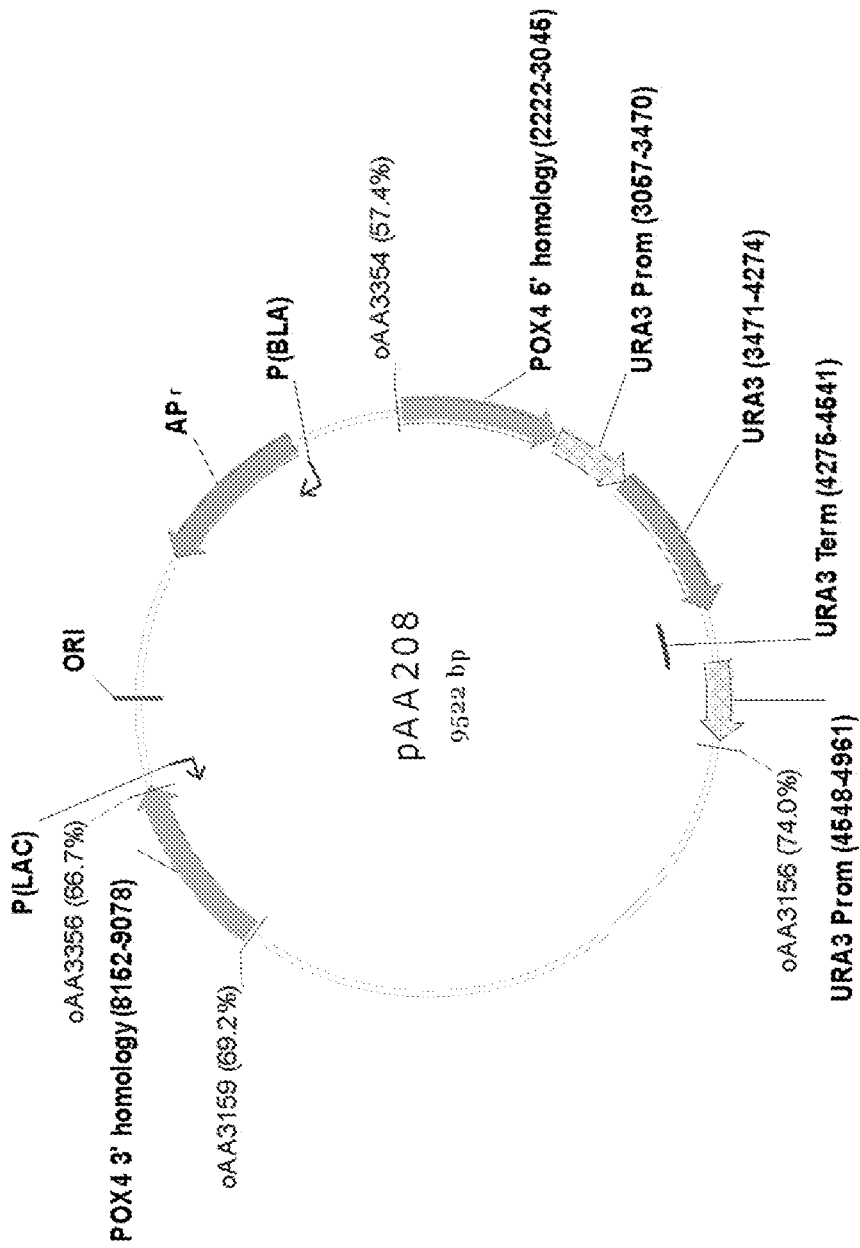

FIG. 36 is a map of plasmid pAA208 which includes two separate portions ("POX4 5' homology" and "POX4 3' homology") of a *Candida* strain ATCC 20336 POX4 gene and a *Candida* strain ATCC 20336 URA3 gene selectable marker with $P_{URA3}$ repeat (URA3 Prom-URA3-URA3 Term-URA3 Prom).

Figure 37:
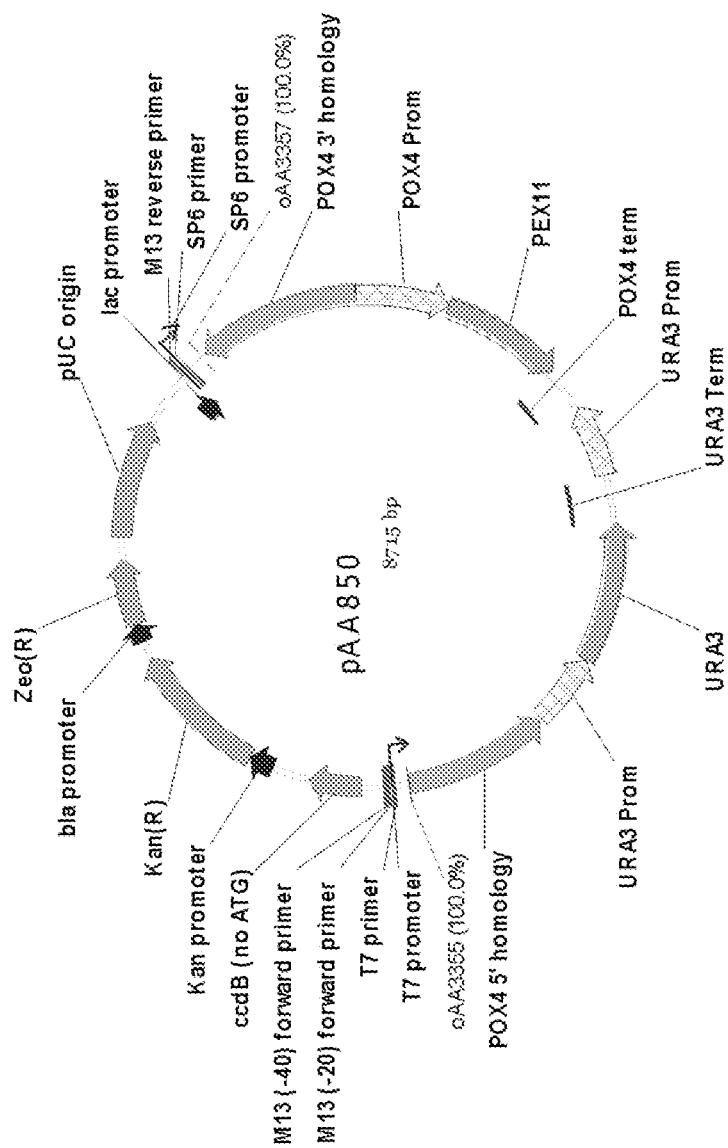

FIG. 37 is a map of plasmid pAA850 which contains a double-crossover knock-in cassette with nucleic acid encoding a *Candida* strain ATCC 20336 PEX11 gene protein. The plasmid contains all the elements of the pCR-BluntII-TOPO vector, two separate portions ("POX4 5' homology" and "POX4 3' homology") of a *Candida* strain ATCC 20336 POX4 gene, elements for the expression of Pex11 protein ("POX4 Prom," "PEX11" and "POX4 term") and a URA3 selectable marker with $P_{URA3}$ repeat (URA3 Prom-URA3-URA3 Term-URA3 Prom). Also shown are the locations of sequences corresponding to oligonucleotides oAA3355 and oAA3357 which can be used as primers in PCR amplification of a linear DNA fragment for use in transforming host cells for disruption of the POX4 gene and expression of Pex11 protein.

FIG. 38 shows a partial amino acid sequence of *Candida* strain ATCC 20336 Pox5p acyl-CoA oxidase and the results of analysis of the amino acid sequence using HotSpot Wizard (a software program tool for identifying sites for engineering of substrate specificity and/or activity of enzymes using a combination of structural, functional and sequence analysis). HotSpot Wizard identified several amino acid positions, or "hotspots," of Pox5p to mutate, with each position given a score from 1 (cold) to 9 (hot). The different HotSpot residues identified are highlighted in the figure and shaded according to the score assigned to the residue.

Figure 39:
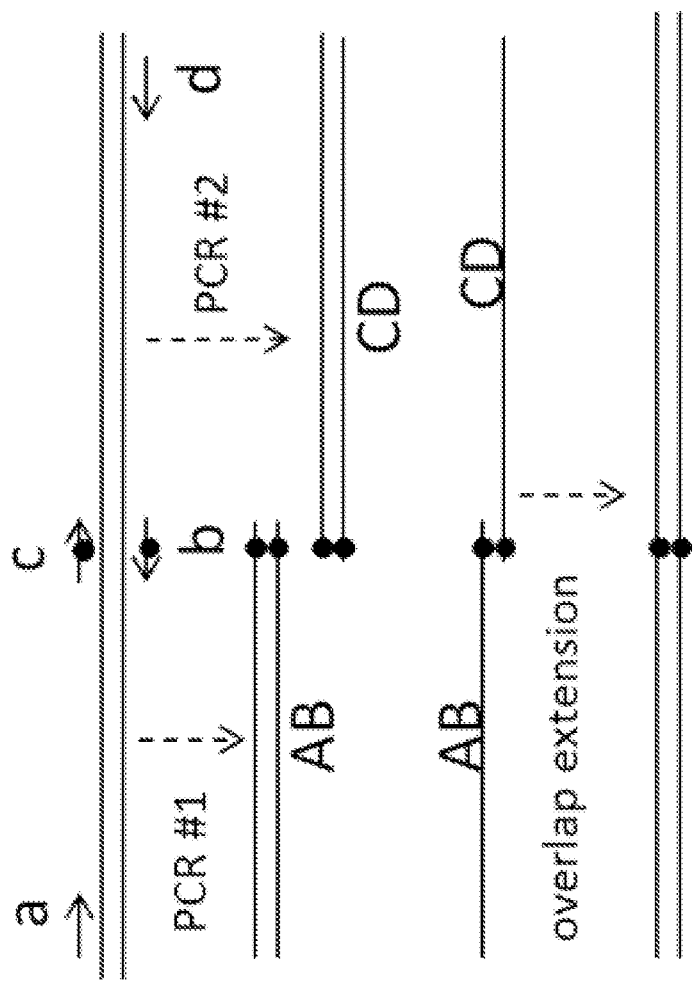

FIG. 39 is an illustration of an overlap extension PCR-based method for generating nucleic acids encoding mutants (F98G and W429F) of a *Candida* strain ATCC 20336 Pox5 acyl-CoA oxidase. The oligonucleotides ("Oligos") used in the PCR amplifications are listed in the table shown in the figure. Oligos B and C contain the desired point mutations. Sequences for each of the oligonucleotides are provided in the Examples herein.

Figure 40:
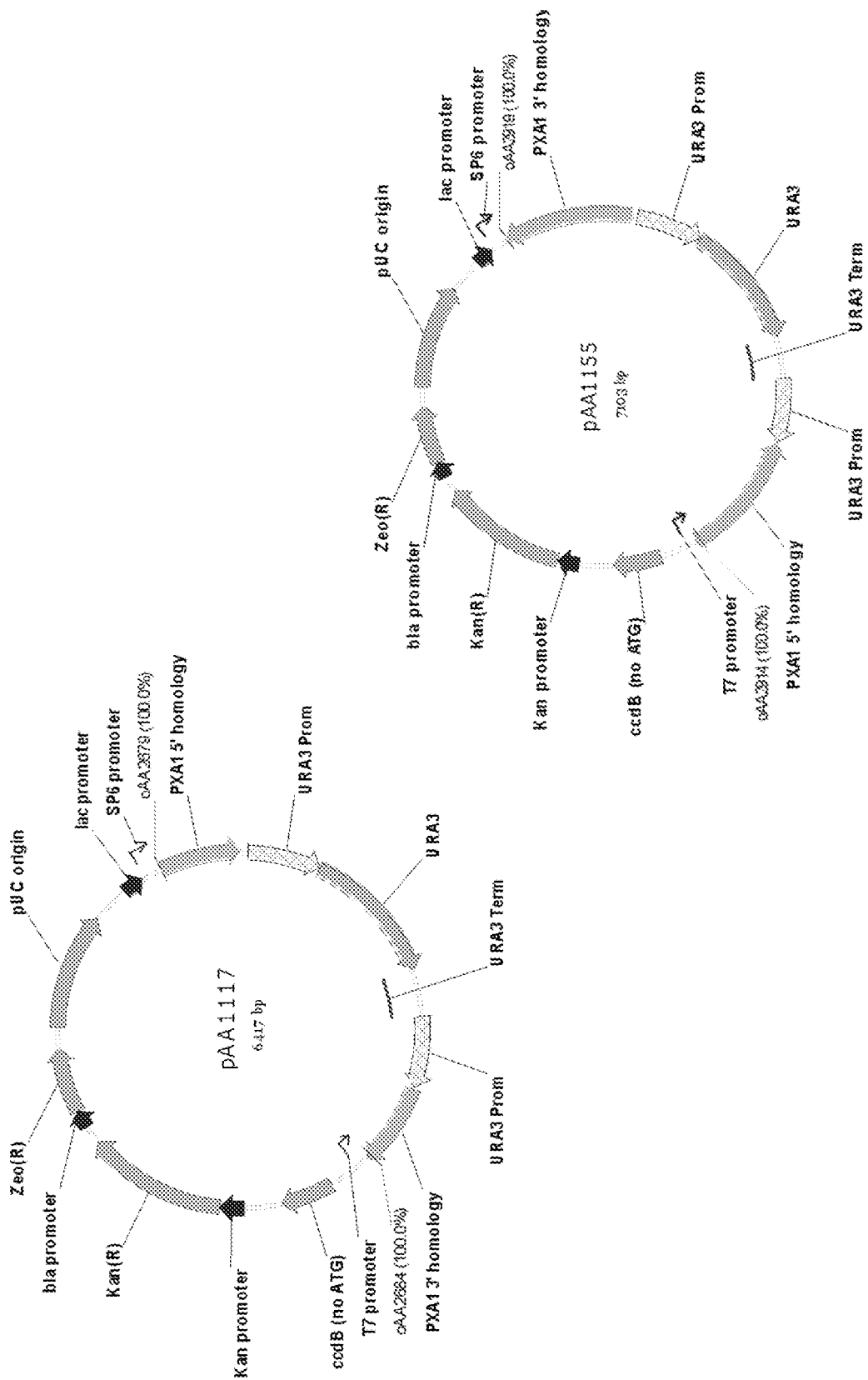

FIG. 40 shows maps of plasmids pAA1117 and pAA1155 which contain *Candida* strain ATCC 20336 PXA1 gene knock-out cassettes that can be used to disrupt alleles of PXA1 genes. Both plasmids contain all the elements of the pCR-BluntII-TOPO vector, two separate portions ("PXA1 5' homology" and "PXA1 3' homology") of a *Candida* strain ATCC 20336 PXA1 gene, and a URA3 selectable marker with $P_{URA3}$ repeat (URA3 Prom-URA3-URA3 Term-URA3 Prom). Also shown are the locations of sequences corresponding to oligonucleotides oAA2679/oAA2684 and oAA2914/oAA2919 which can be used as primers in PCR amplification of pAA1117 and pAA1155, respectively, to obtain a linear DNA fragment for use in transforming host cells for disruption of the PXA1 gene. Plasmids pAA1117 and pAA1155 differ in the sizes of PXA1 gene 5' and 3' homology sequences and the orientation of the URA3 selectable marker nucleic acid sequence contained in the plasmids.

Figure 41:
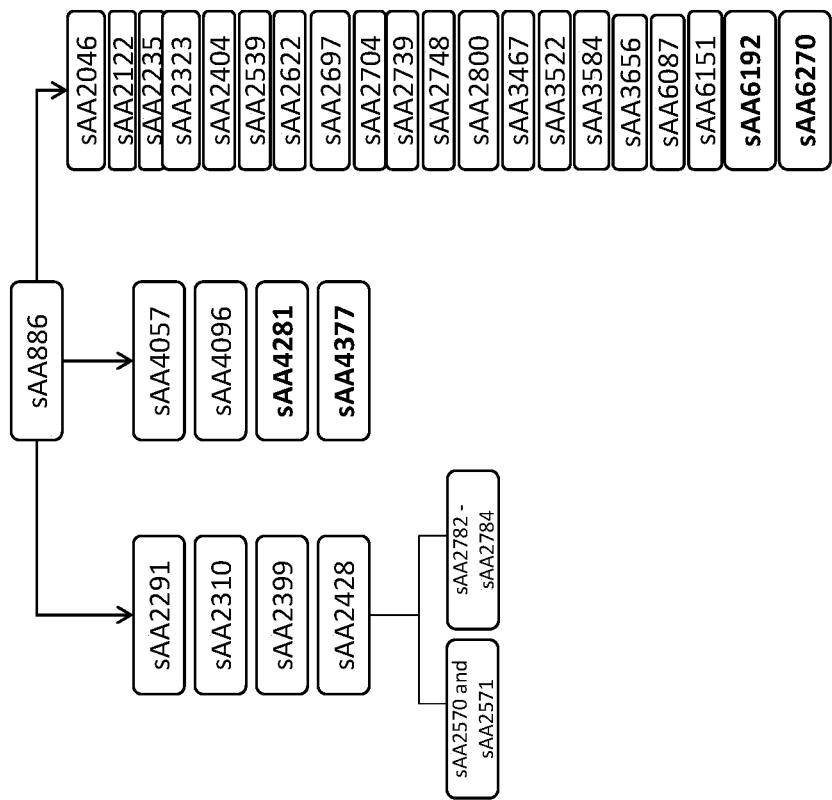

FIG. 41 is a flow diagram showing the parent-daughter relationship for exemplary engineered yeast strains that can be used in generating cells and organisms for use in target molecule platform and production systems described herein. Strains in bold type are Crc⁻ strains.

Figure 42:
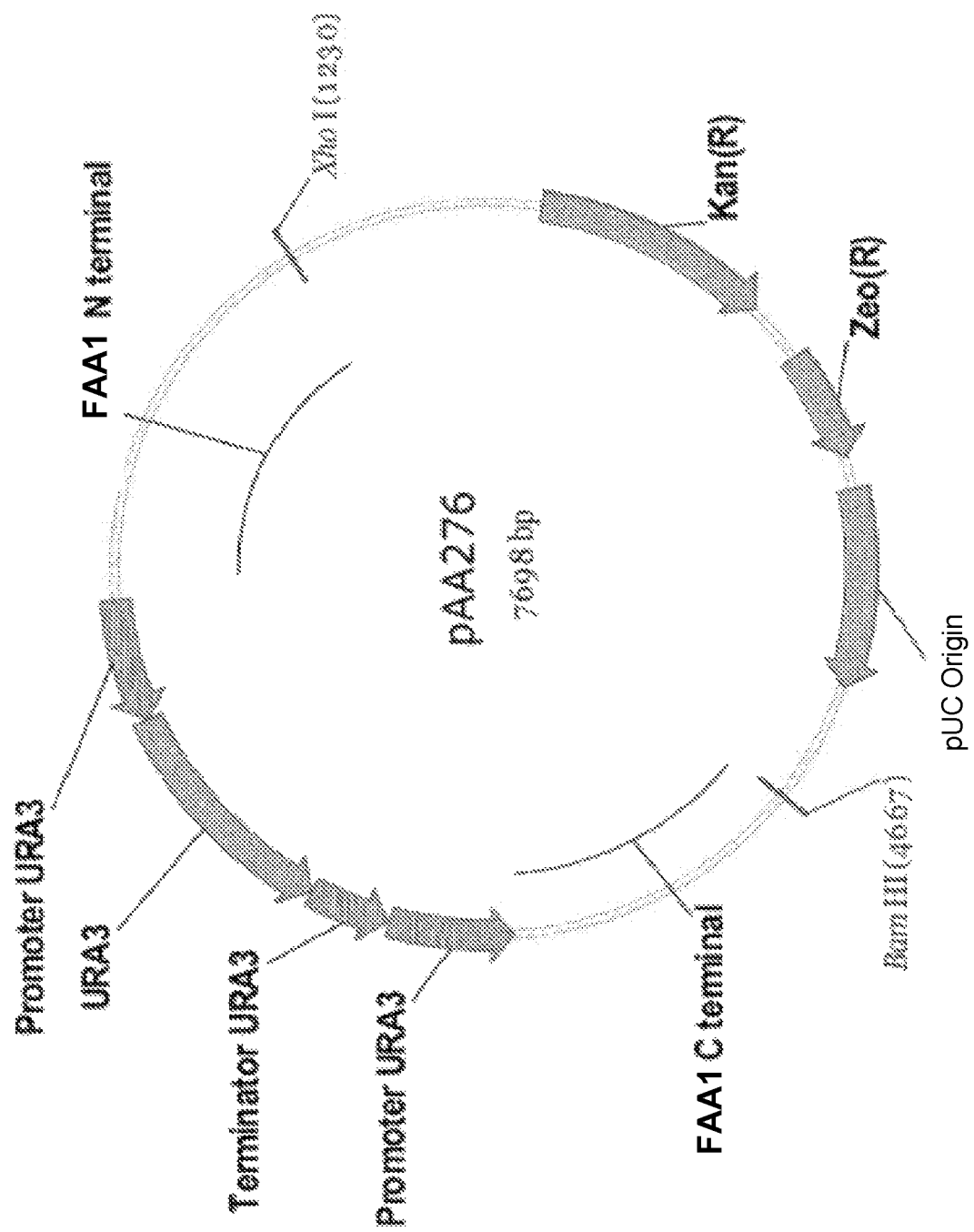

FIG. 42 shows a restriction endonuclease site map of plasmid pAA276 which contains a *Candida* strain ATCC 20336 FAA1 gene knock-out cassette that can be used to disrupt alleles of FAA1 genes. The plasmid contains all the elements of the pCR-BluntII-TOPO vector, two separate portions ("FAA1 N terminal" and "FAA1 C terminal") of a *Candida* strain ATCC 20336 FAA1 gene, and a URA3 selectable marker with URA3 Promoter repeat (Promoter URA3-URA3-Terminator URA3-Promoter URA3).

Figure 43:
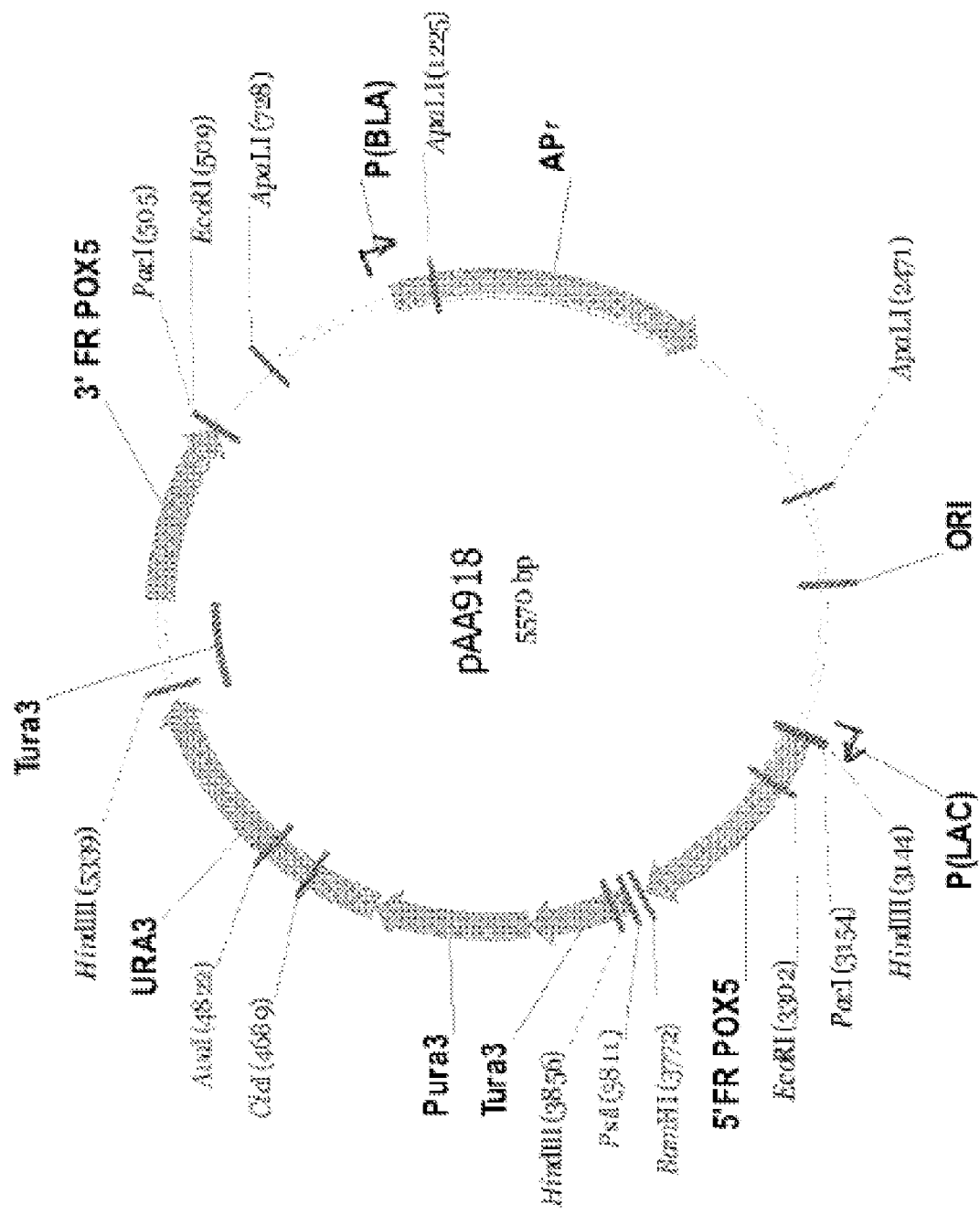

FIG. 43 shows a restriction endonuclease site map of plasmid pAA918 which contains a *Candida* strain ATCC 20336 POX5 gene knock-out cassette that can be used to disrupt alleles of POX5 genes. The plasmid contains all the elements of the pCR-BluntII-TOPO vector, two separate portions ("5' FR POX5" and "3' FR POX5") of a *Candida* strain ATCC 20336 POX5 gene, and a URA3 selectable marker with URA3 terminator repeat (Tura3-Pura3-URA3-Tura3).

Figure 44:
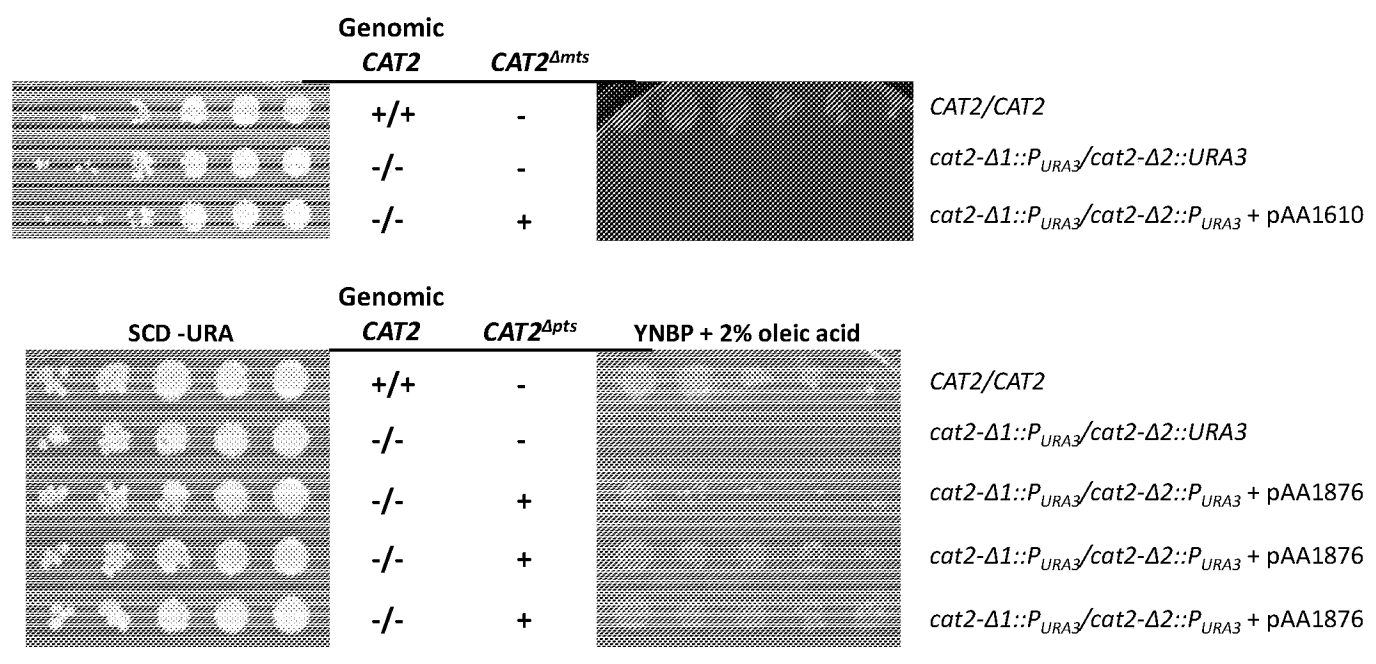

FIG. 44 shows photographs of the agar plates obtained from spot growth assays of wild-type *Candida* strain ATCC 20336 ("CAT2/CAT2") and mutant strains as follows: cat2-$\Delta 1$::$P_{URA3}$/cat2-$\Delta 2$::URA3 (sAA4594) and a Cat2$^-$ *Candida* strain (cat2-$\Delta 1$::$P_{URA3}$/cat2-$\Delta 2$::$P_{URA3}$) that had been transformed with either pAA1610 or pAA1876. The upper and lower photographs on the left side of the figure are control agar plates containing synthetic complete media with dextrose minus uracil ("SCD-URA"), and the upper and lower photographs on the right side of the figure are plates containing yeast nitrogen base without amino acids, plus phosphate and 2% oleic acid ("YNBP+2% oleic acid"). Each row of "spots" corresponds to serial dilutions of cells of the strain designated to the right of each row (increasing dilutions from right-to-left for the control agar plates and from left-to-right for the plates containing YNBP+2% oleic acid).

Figure 45:
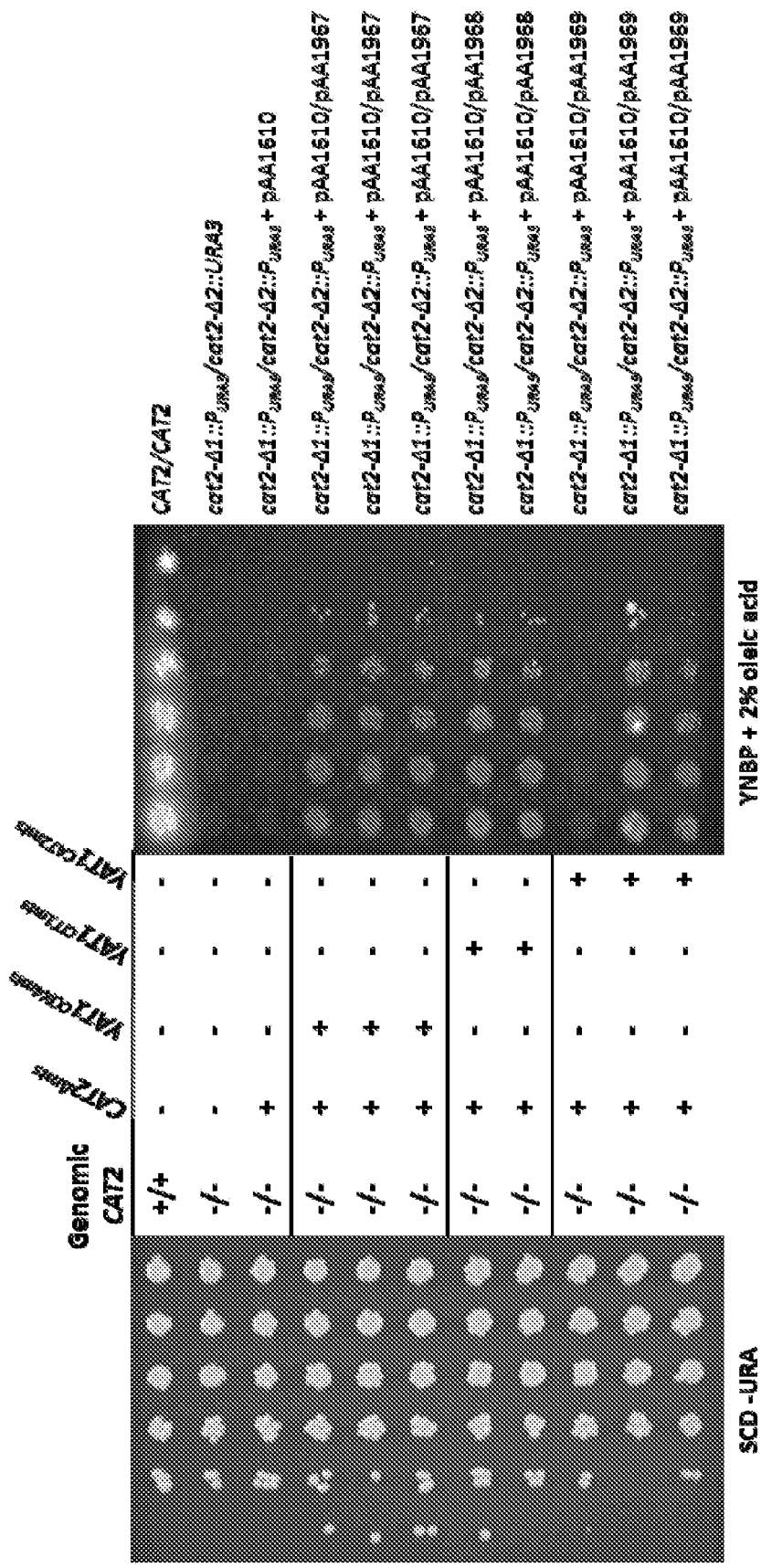

FIG. 45 shows photographs of the agar plates obtained from spot growth assays of wild-type *Candida* strain ATCC 20336 ("CAT2/CAT2") and mutant strains as follows: cat2-$\Delta 1$::$P_{URA3}$/cat2-$\Delta 2$::URA3 (sAA4594) and a Cat2$^-$ *Candida* strain (cat2-$\Delta 1$::$P_{URA3}$/cat2-$\Delta 2$::$P_{URA3}$) that had been transformed with one or more of plasmids pAA1610, pAA1967, pAA1968 and pAA1969. The photograph on the left side of the figure is of control agar plates containing synthetic complete media with dextrose minus uracil ("SCD-URA"), and the photograph on the right side of the figure is of plates containing yeast nitrogen base without amino acids, plus phosphate and 2% oleic acid ("YNBP+2% oleic acid"). Each row of "spots" corresponds to serial dilutions of cells of the strain designated to the right of each row (increasing dilutions from right-to-left for the control agar plates and from left-to-right for the plates containing YNBP+2% oleic acid).

Figure 46:
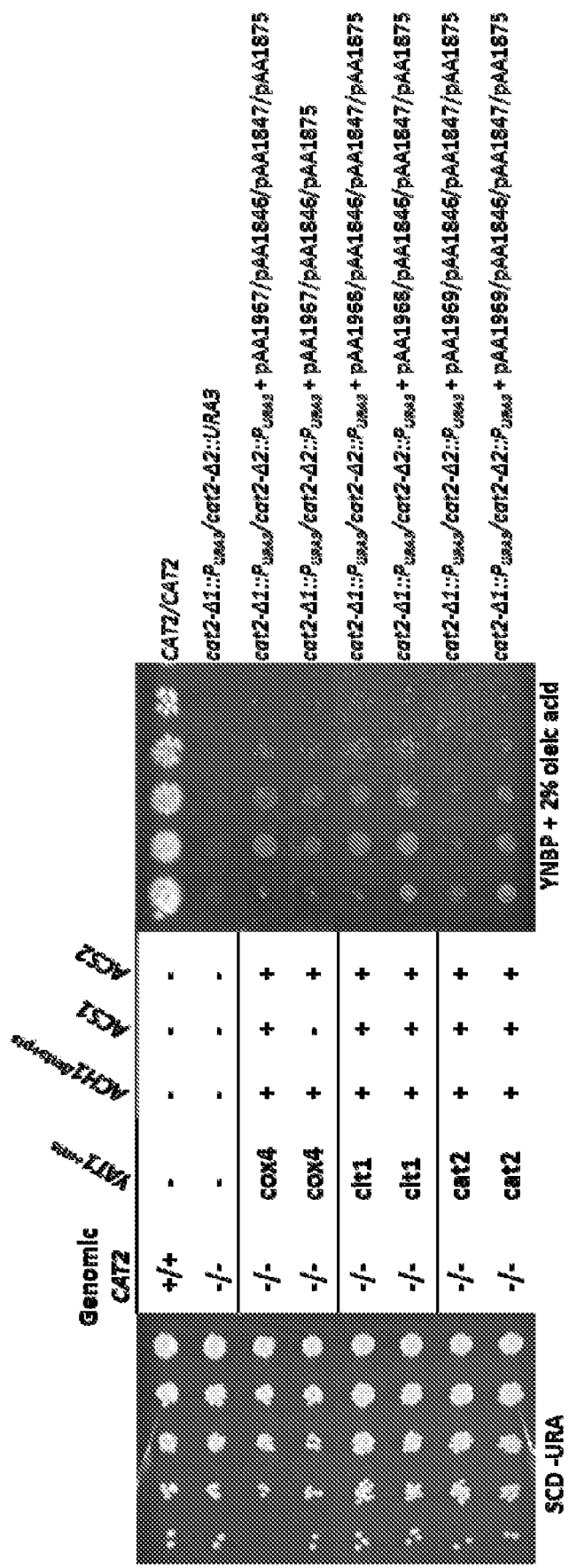

FIG. 46 shows photographs of the agar plates obtained from spot growth assays of wild-type *Candida* strain ATCC 20336 ("CAT2/CAT2") and mutant strains as follows: cat2-$\Delta 1$::$P_{URA3}$/cat2-$\Delta 2$::URA3 (sAA4594) and a Cat2$^-$ *Candida* strain (cat2-$\Delta 1$::$P_{URA3}$/cat2-$\Delta 2$::$P_{URA3}$) that had been transformed with pAA1846, pAA1875 and one or more of plasmids pAA1967, pAA1968, pAA1969 and pAA1847. The photograph on the left side of the figure is of control agar plates containing synthetic complete media with dextrose minus uracil ("SCD-URA"), and the photograph on the right side of the figure is of plates containing yeast nitrogen base without amino acids, plus phosphate and 2% oleic acid ("YNBP+2% oleic acid"). Each row of "spots" corresponds to serial dilutions of cells of the strain designated to the right of each row (increasing dilutions from right-to-left for the control agar plates and from left-to-right for the plates containing YNBP+2% oleic acid).

Figure 47:
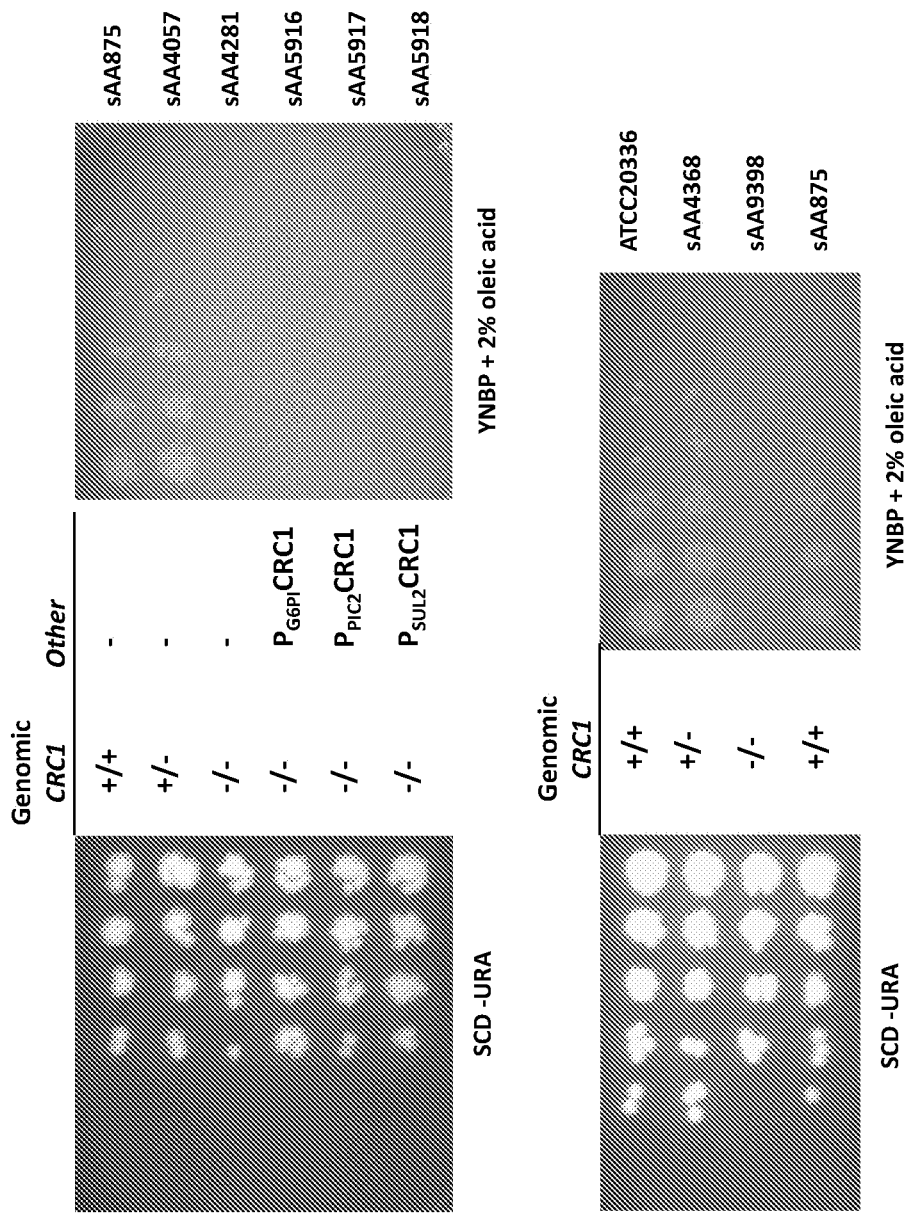

FIG. 47 shows photographs of the agar plates obtained from spot growth assays of wild-type *Candida* strain ATCC 20336 and mutant strains as follows: ura3/ura3 pox4a::ura3/pox4b::ura3 faa1::$P_{URA3}$/faa1::$P_{URA3}$ fat1-$\Delta 1$::$P_{URA3}$/fat1-$\Delta 2$::URA3 (sAA875), ura3/ura3 pox4a::ura3/pox4b::ura3 faa1::$P_{URA3}$/faa1::$P_{URA3}$ fat1-$\Delta 1$::$P_{URA3}$/fat1-42::$P_{URA3}$ crc1-$\Delta 1$::URA3/CRC1 (sAA4057), ura3/ura3 pox4a::ura3/pox4b::ura3 faa1::$P_{URA3}$/faa1::$P_{URA3}$ fat1-$\Delta 1$::$P_{URA3}$/fat1-$\Delta 2$::$P_{URA3}$ crc1-$\Delta 1$::$P_{URA3}$/crc1-$\Delta 2$::URA3 (sAA4281), ura3/ura3 crc1-$\Delta 1$::URA3/CRC1 (sAA4368), and ura3/ura3 crc1-$\Delta 1$::$P_{URA3}$/crc1-$\Delta 2$::URA3 (sAA9398). Also shown are the agar plates obtained from spot growth assays of strains sAA5916, sAA5917 and sAA5918 generated by transforming strain sAA4377 (ura3/ura3 pox4a::ura3/pox4b::ura3 faa1::$P_{URA3}$/faa1::$P_{URA3}$ fat1-$\Delta 1$::$P_{URA3}$/fat1-$\Delta 2$::$P_{URA3}$ crc1-$\Delta 1$::$P_{URA3}$/crc1-$\Delta 2$::$P_{URA3}$) with a double-crossover integration cassette containing DNA encoding a *Candida* strain ATCC 20336 Crc1p linked to the G6PI, PIC2 or SUL2 promoter, respectively. The photographs on the left side of the figure are of control agar plates containing synthetic complete media with dextrose minus uracil ("SCD-URA"), and the photographs on the right side of the figure are of plates containing yeast nitrogen base without amino acids, plus phosphate and 2% oleic acid ("YNBP+2% oleic acid"). Each row of "spots" corresponds to serial dilutions of cells of the strain designated to the right of each row (increasing dilutions from right-to-left for the control agar plates and from left-to-right for the plates containing YNBP+2% oleic acid).

Figure 48A:
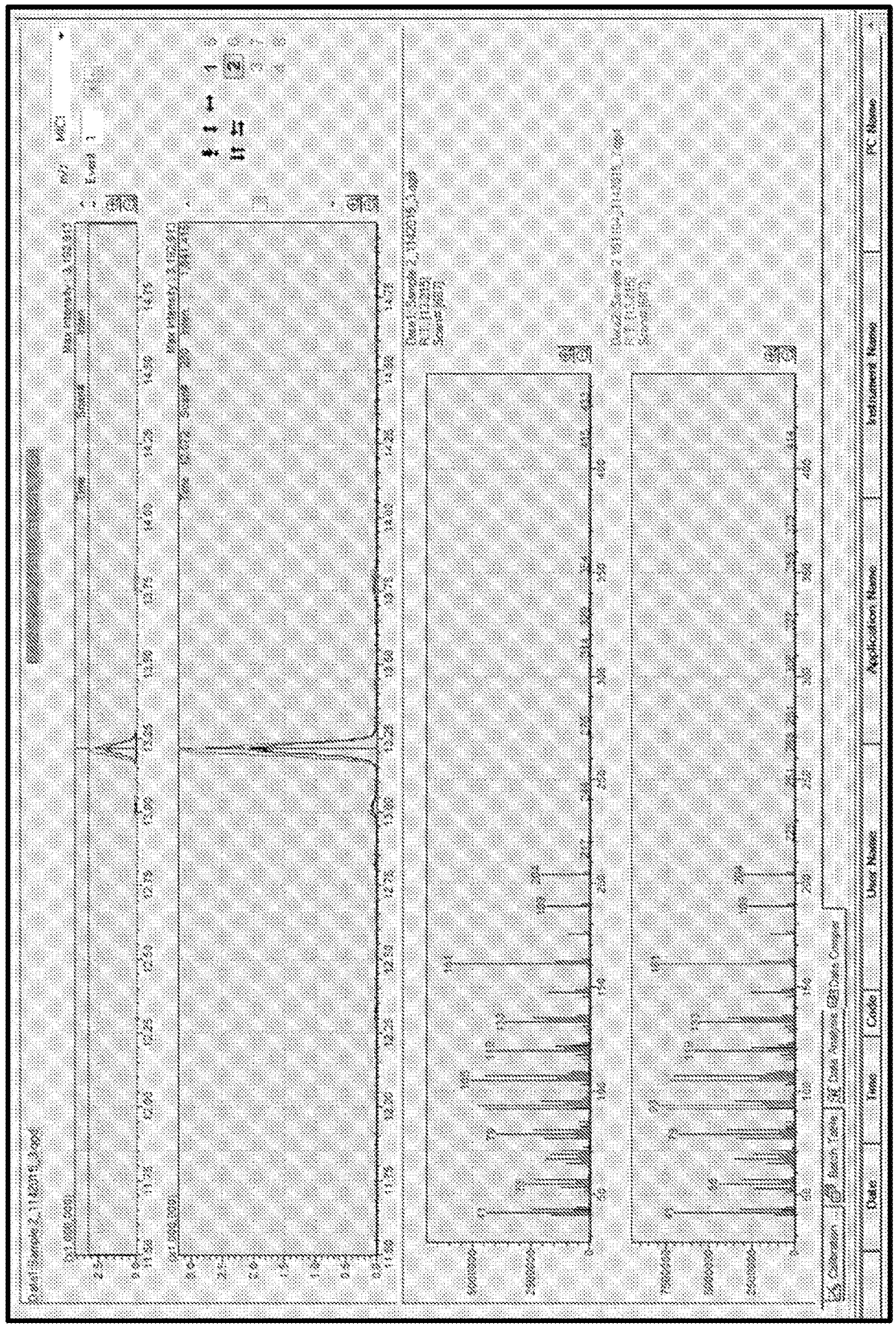
Figure 48B:
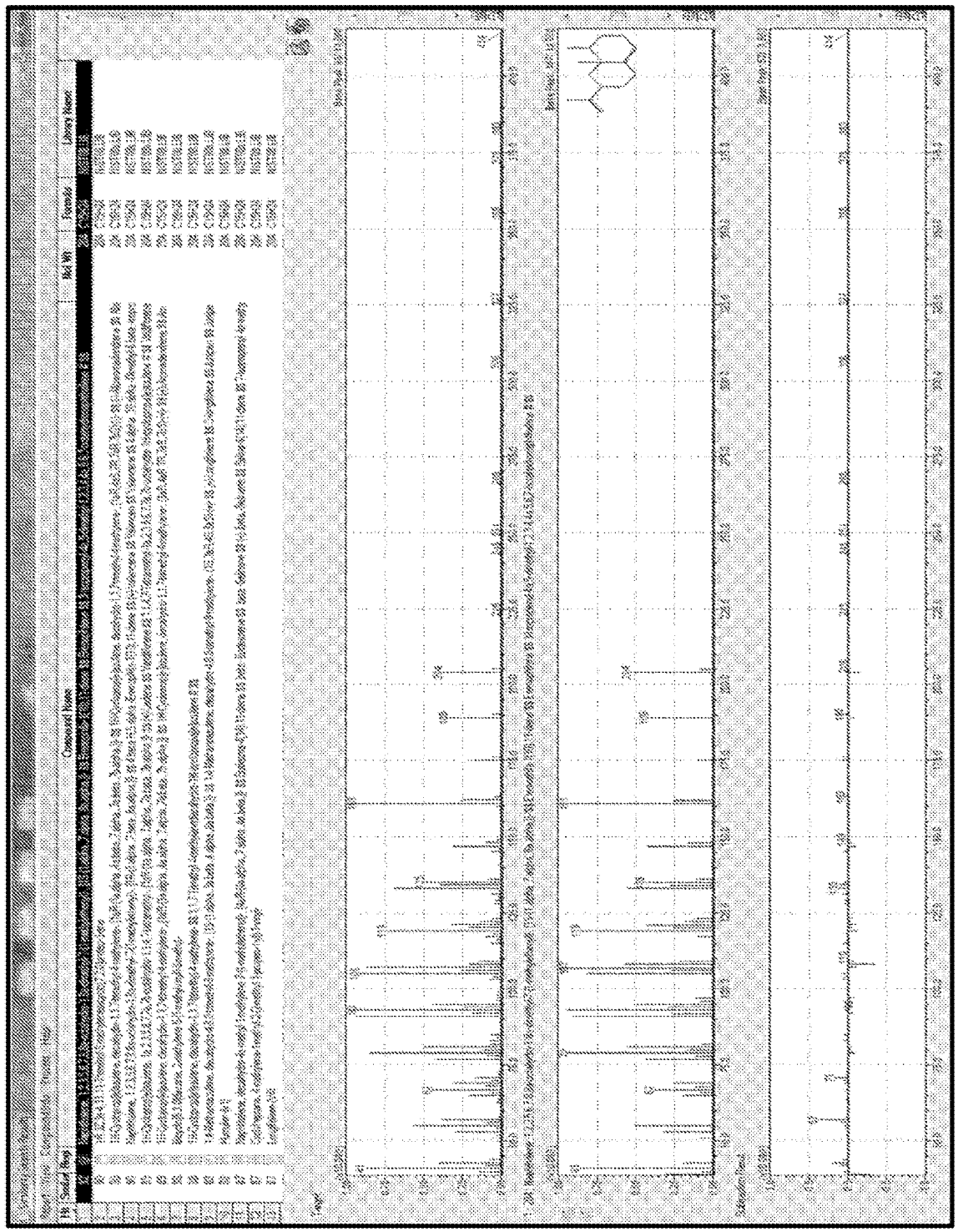

FIG. 48A shows GC-MS of valencene production from sAA7449 with its library match shown in FIG. 48B.

Figure 49A:
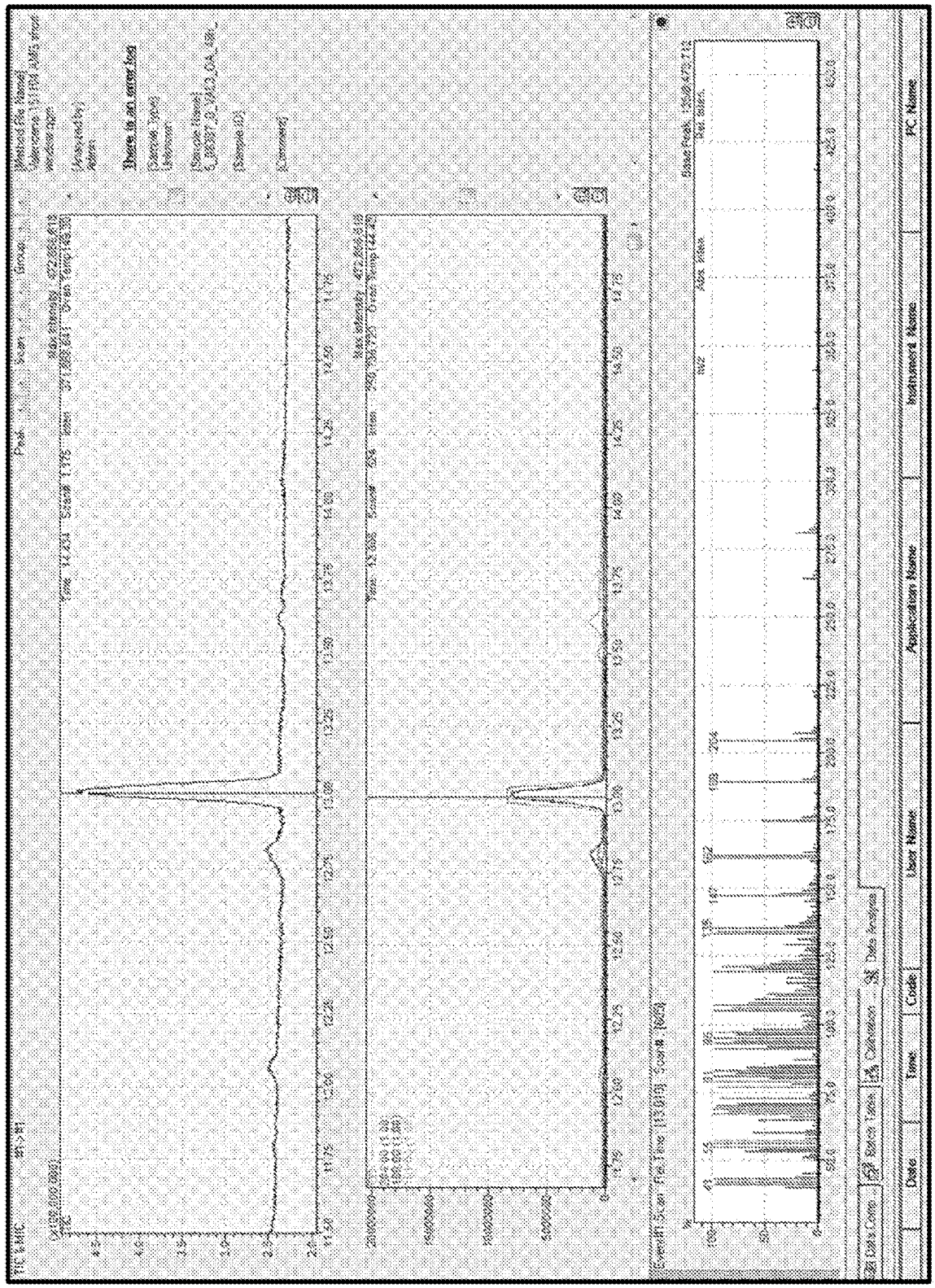
Figure 49B:
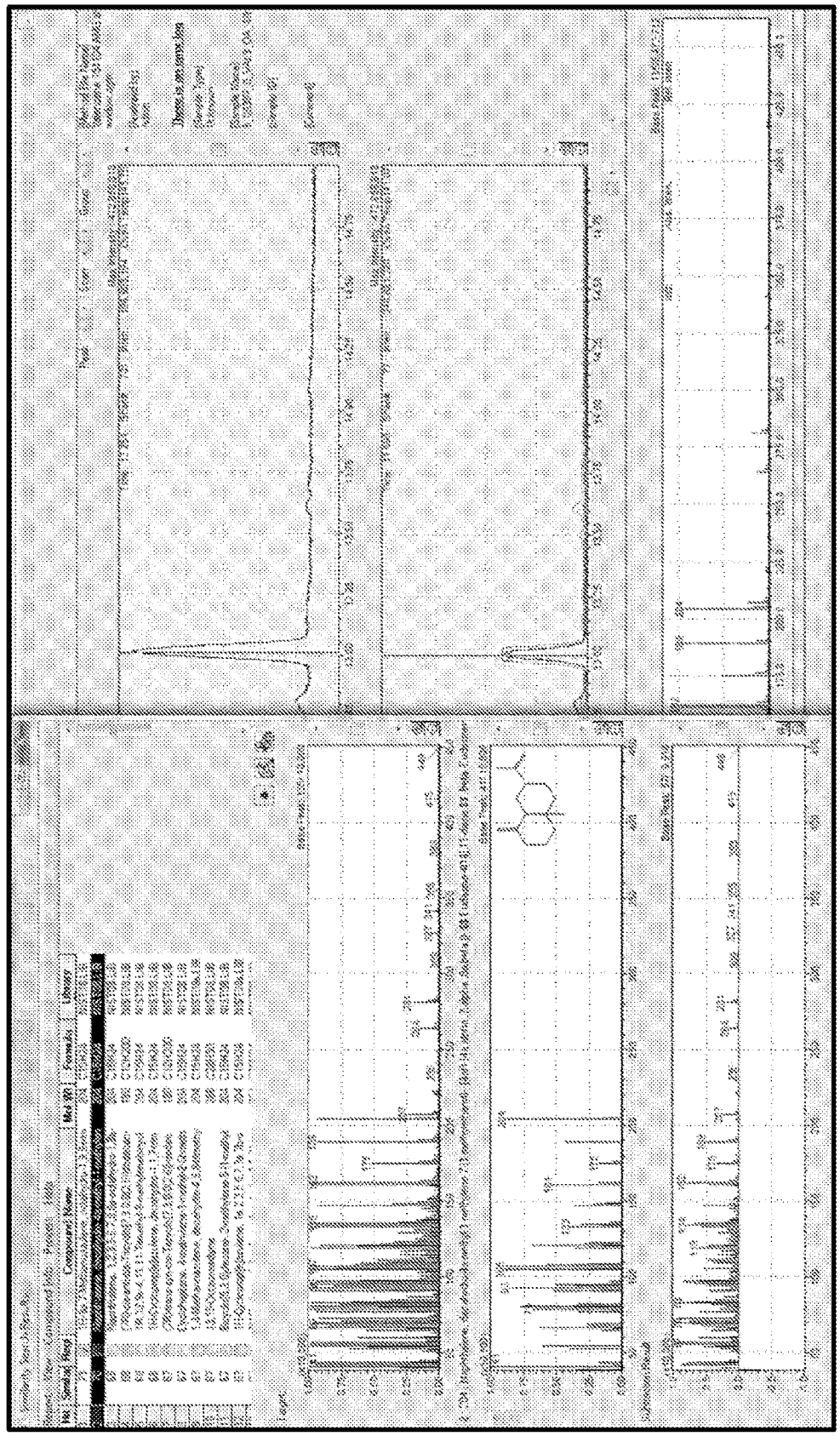

FIG. 49A shows GC-MS of valencene production from sAA7453 with its library match shown in FIG. 49B.

Figure 50:
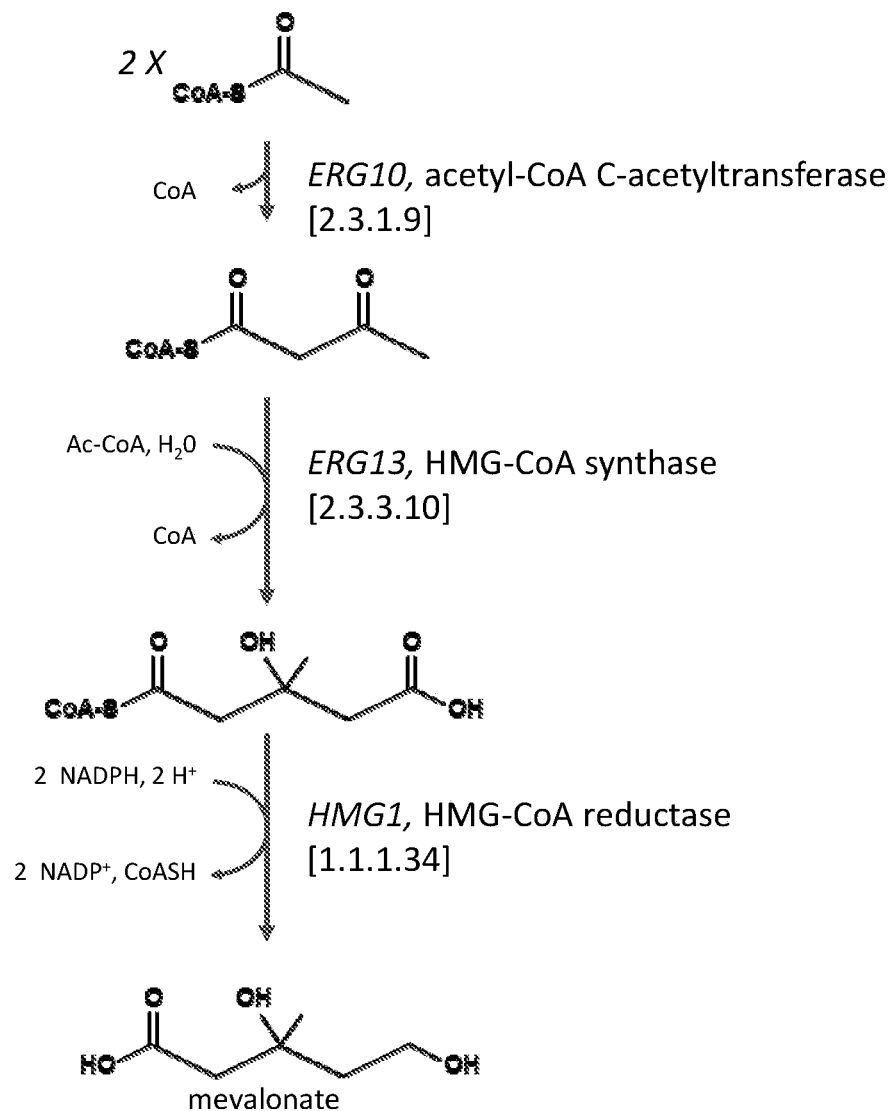

FIG. 50 shows the yeast upper mevalonate pathway. The enzymes acetyl-CoA C-acetyltransferase (ERG10), HMG-CoA synthase (ERG13), and HMG-CoA reductase (HMG1), are native to yeast described herein. The bracketed number under each enzyme refers to the IUBMB enzyme nomenclature for the enzyme.

Figure 51:
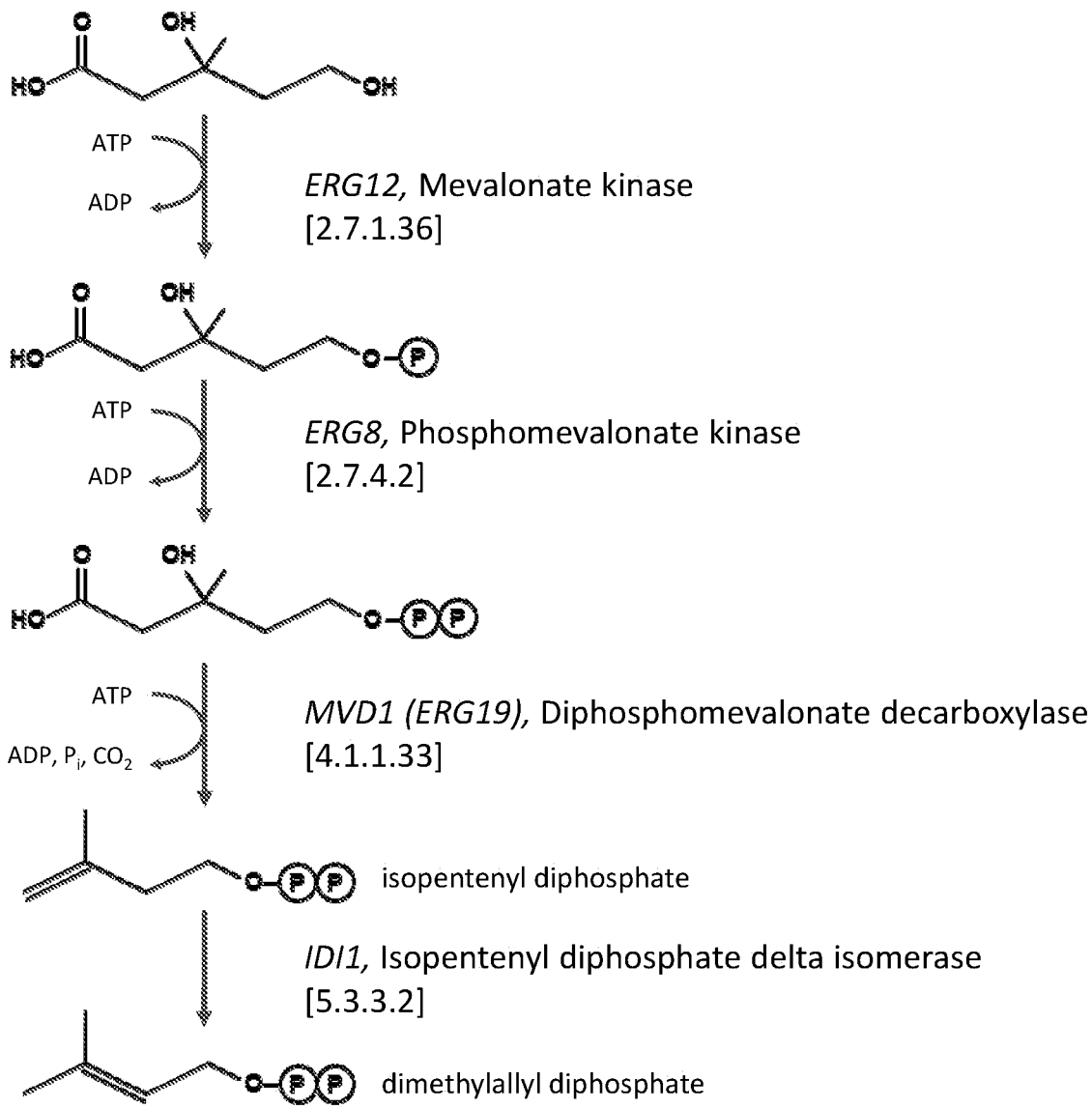

FIG. 51 shows the yeast lower mevalonate pathway. The enzymes Mevalonate kinase (ERG12), Phosphomevalonate kinase (ERG8), Diphosphomevalonate decarboxylase (MVD1; ERG19), Isopentenyl diphosphate delta isomerase (ID/1), are native to yeast described herein. The bracketed number under each enzyme refers to the IUBMB enzyme nomenclature for the enzyme.

Figure 52:
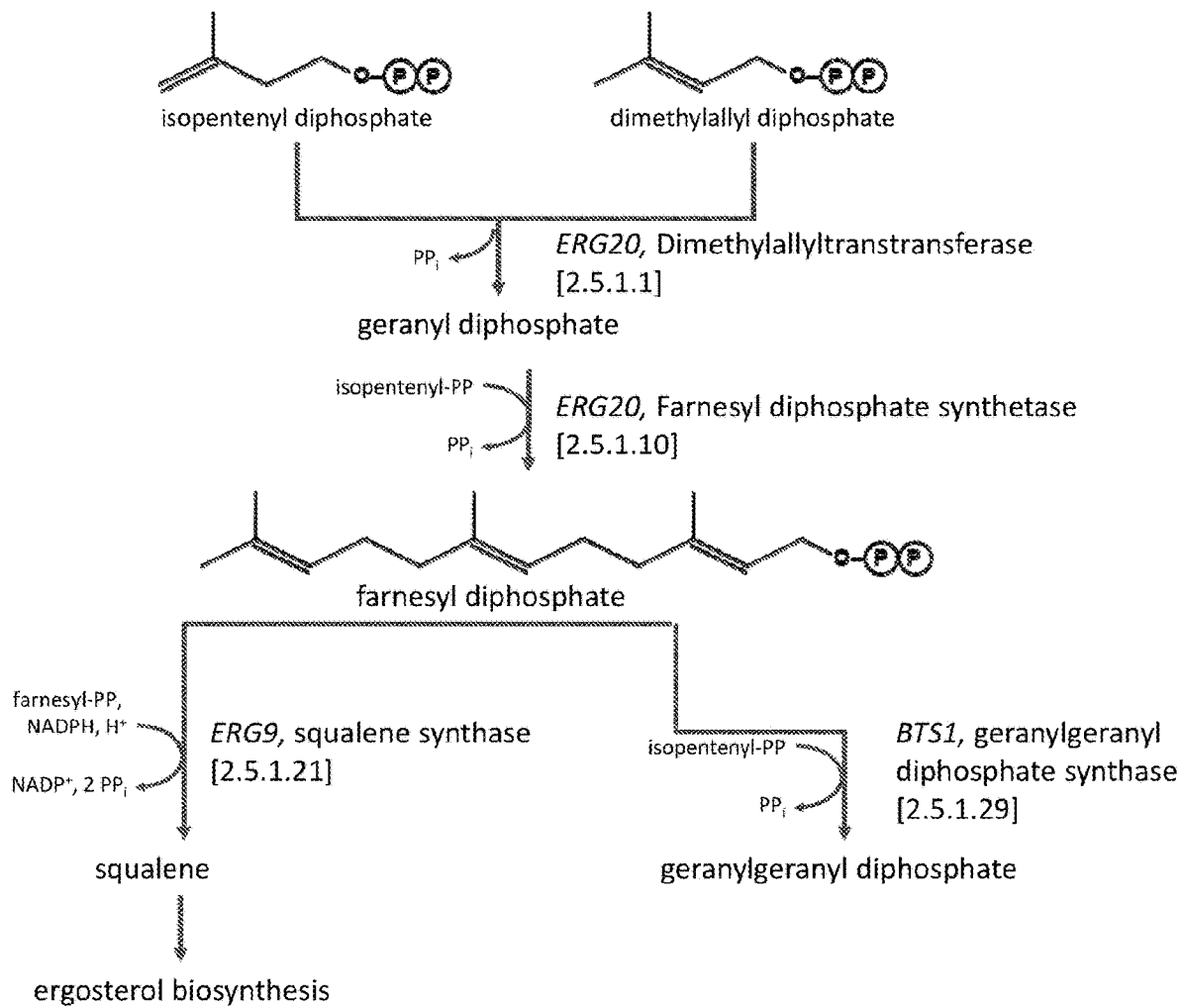

FIG. 52 shows a biosynthetic pathway to ergosterol or geranylgeranyl diphosphate. ERG20, ERG9, and BTS1 are native to yeast described herein.

Figure 53:
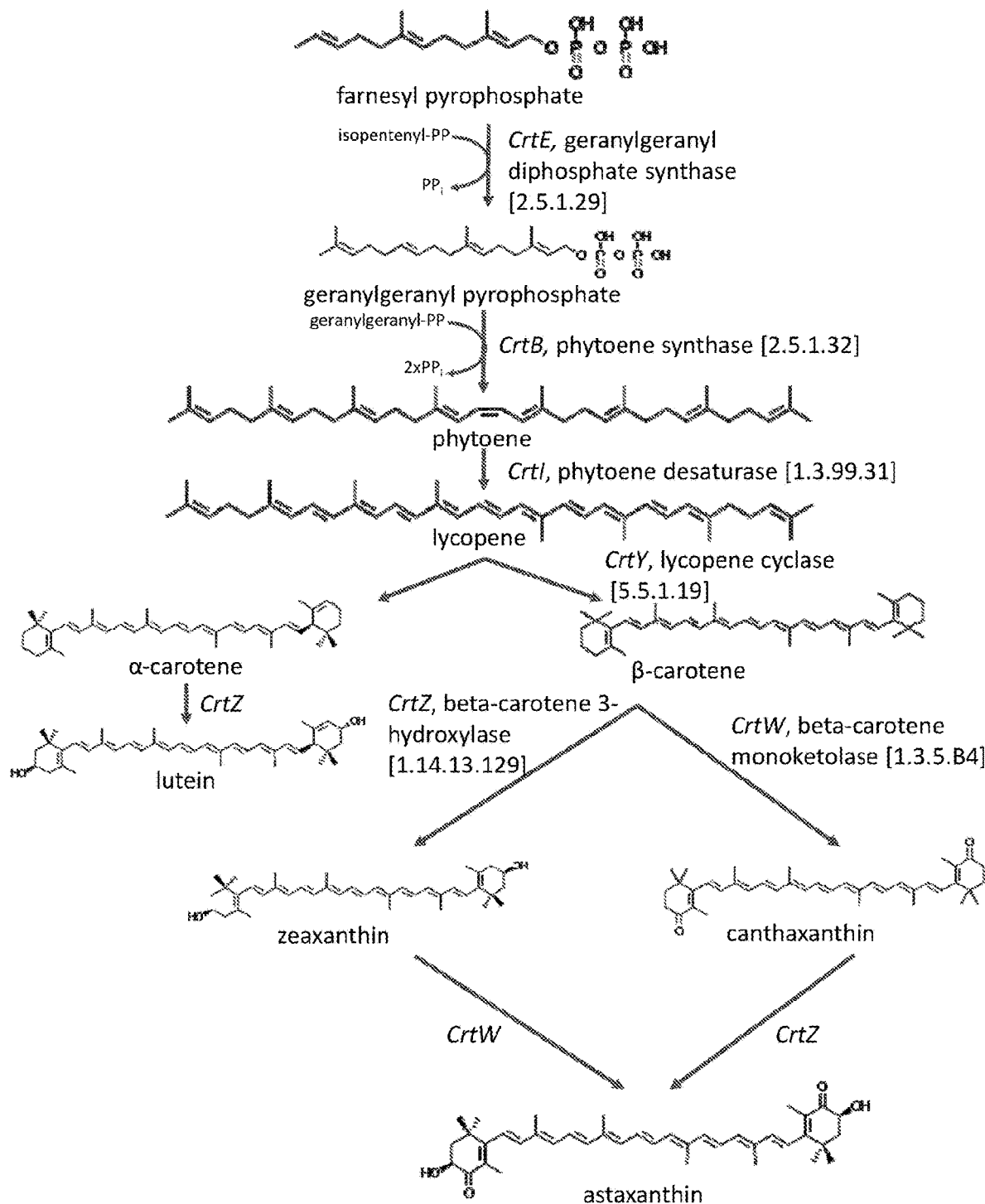

FIG. 53 shows carotenoid production from farnesyl pyrophosphate. CrtE, CrtB, CrtI, CrtY, CrtZ, and CrtW are heterologous genes.

Figure 54:
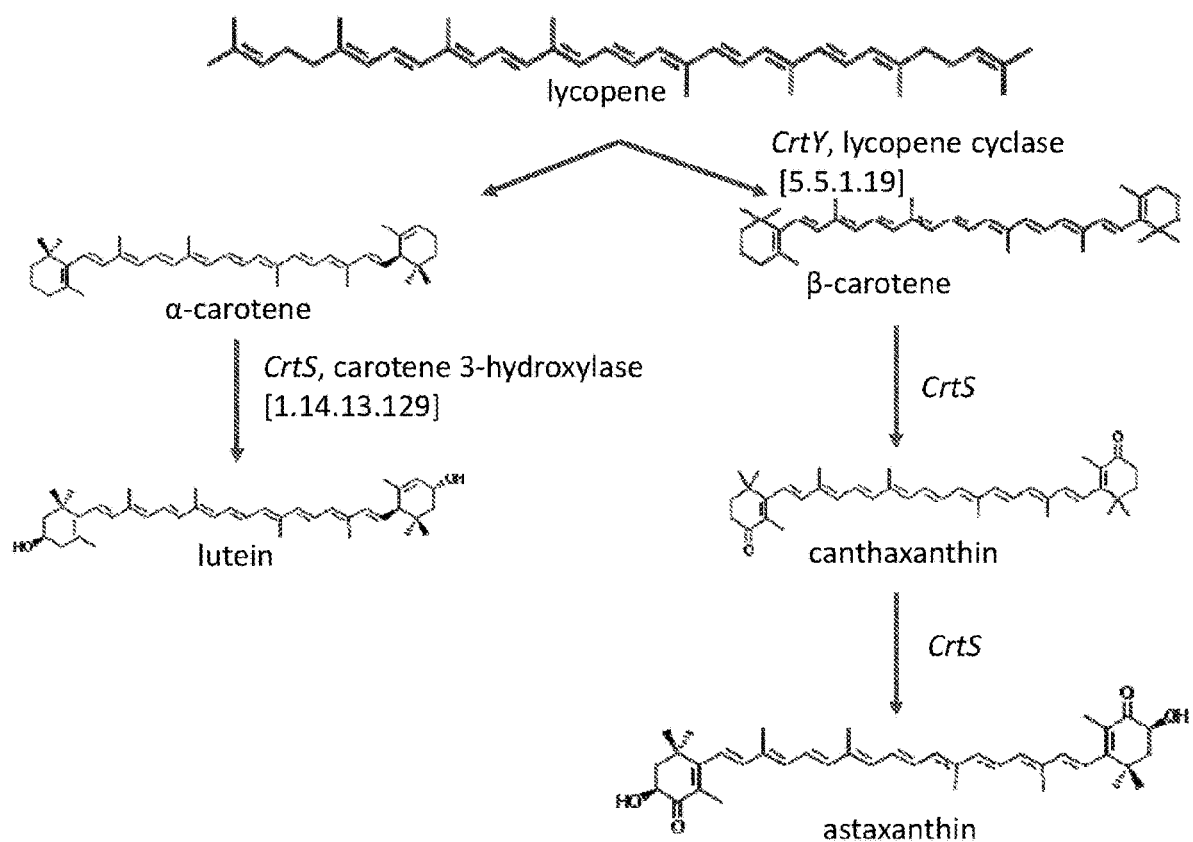

FIG. 54 shows an alternative route to lutein, canthaxanthin, and astaxanthin from β-carotene by the cytochrome P450 hydroxylase CrtS. CrtS is a heterologous enzyme which requires the activity of CrtR, a heterologous cytochrome p450 reductase.

Figure 55:
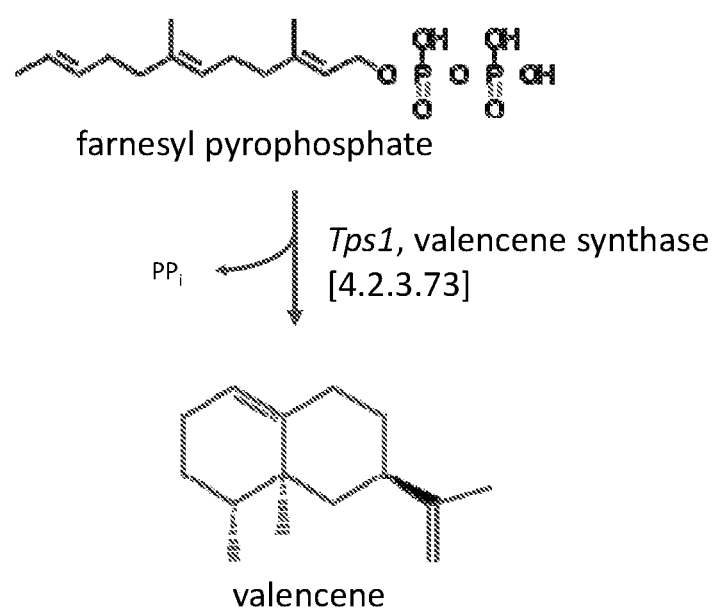

FIG. 55 shows a route from farnesyl pyrophosphate to valencene by TPS1, a heterologous valencene synthase.

Figure 56:
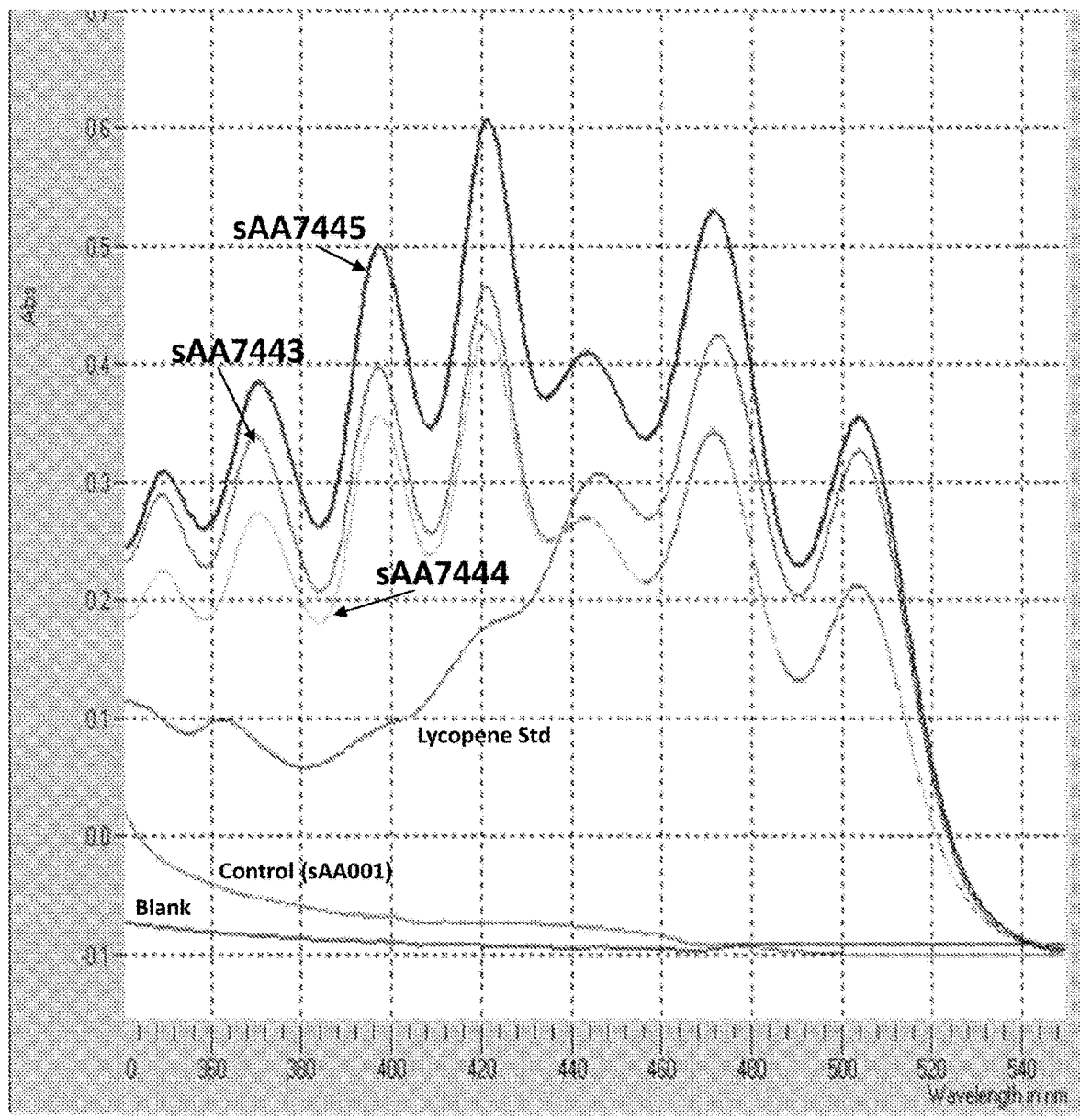

FIG. 56 show an absorption spectra of extracted carotenoids from sAA001, sAA7443, sAA7444, and sAA7445. Strains sAA7443, aAA7444 and sAA7445 are generated from sAA001 plus CsCrtE, CsCrtB and CsCrtI each under a glyceraldehyde-3-phosphate dehydrogenase (GPD) promoter. Lycopene absorption maxima are expected at 443, 472, and 502 nm.

Figure 57:
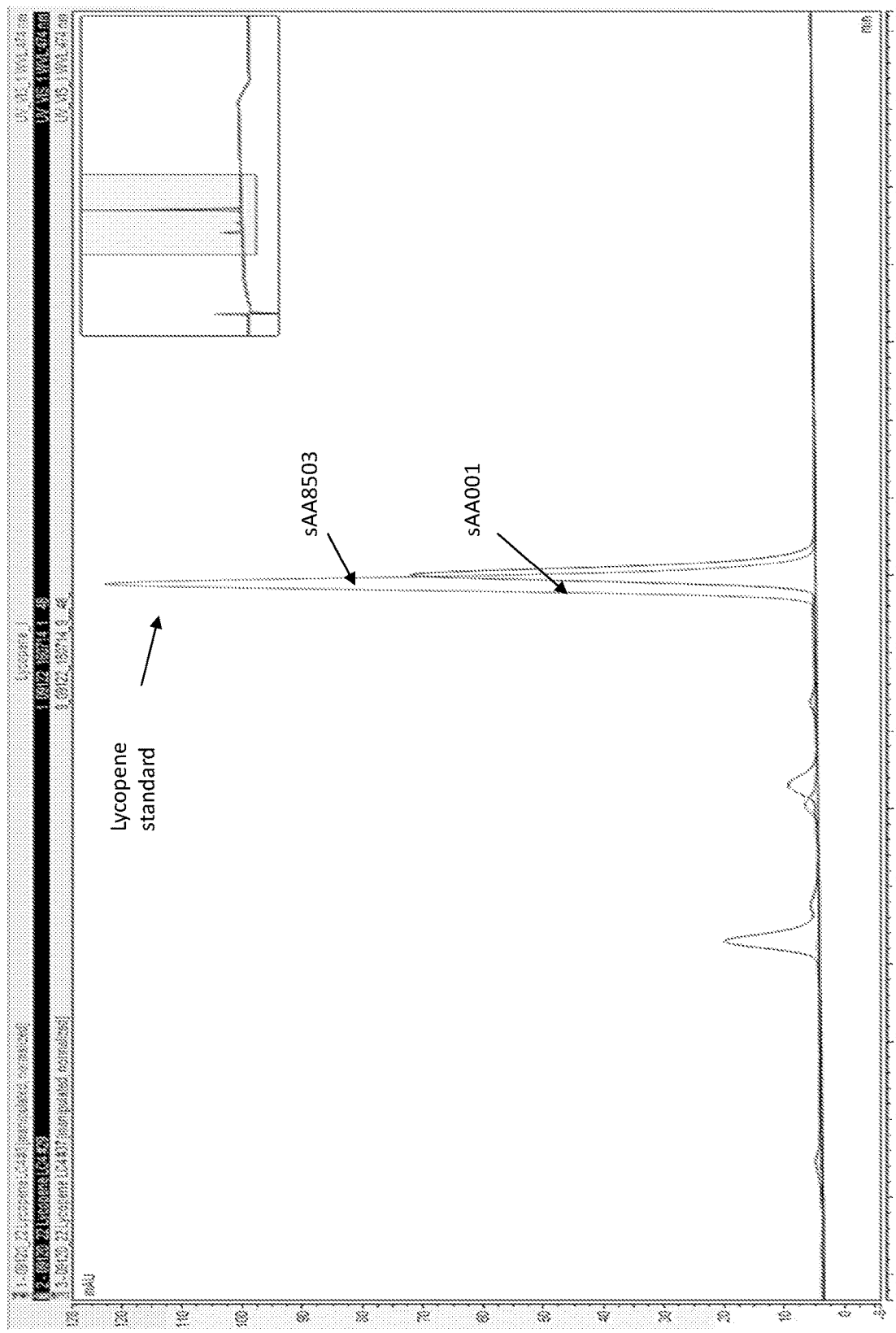

FIG. 57 shows an HPLC chromatogram of lycopene production in sAA001 and sAA8503.

DETAILED DESCRIPTION

There are multiple cellular metabolic pathways that utilize carbon-containing molecules for varying purposes, such as, for example, biomass production, energy generation and growth. Different metabolic pathways can occur in distinct areas of the cell. For example, in eukaryotic microorganisms metabolic processes such as glycolysis, the pentose phosphate pathway and gluconeogenesis occur in the cytoplasm, whereas β-oxidation, the tricarboxylic acid (TCA) cycle and glyoxylate cycle are carried out, in whole or in part, in cellular organelles. The different metabolic pathways can be differentially utilized to maintain the basic functions required for survival of a microorganism under a variety of conditions (e.g., varying carbon source, nutrient, and oxygen availabilities). These features contribute to the ability of microorganisms to readily adapt to a variety of environmental conditions. The adaptability of microorganisms facilitates manipulation of microbial metabolic processes for the production of commercially useful materials (e.g., proteins, lipids, and organic acids).

There are a number of molecules that are valuable as final products, and/or as raw materials in generating a desired product, that incorporate carbon atoms resulting from catabolic and anabolic carbon-metabolism pathways in microorganisms. A desired molecule that can be produced in cells and microorganisms is referred to herein as a "target" molecule or product. Some of these molecules are generated in wild-type microorganisms, whereas others that are not produced in a native microorganism can be generated through modification of a wild-type organism. In either case, the goal in the development of cellular and microbial production systems is to maximize yield and efficiency and minimize loss for process economy. Biological cell- or organism-based systems for production of carbon-containing molecules, such as, for example, polymers of substituted or unsubstituted hydrocarbons, may not be optimally efficient due to loss of carbon atoms that are transferred into other, non-target-producing, metabolic processes in the cell. In order for a bioproduction system to be cost-efficient and economically viable, it generally should meet certain metrics of titer, rate and yield with minimal by-product formation.

In order to minimize carbon loss and increase process efficiency of biological cell-based production systems, provided herein are modified cells and organisms (e.g., microorganisms) in which the flux of cellular carbon has been altered relative to an unmodified cell or organism. In some aspects, the cells or organisms are modified to redirect carbon from entering one or more growth and/or energy production metabolic pathways so that it is available for use in other inherent and/or engineered production processes. Alteration of carbon flux facilitates engineering of the cells or organisms for enhanced production of desired target molecules, including, for example, organic acids, terpenes and precursor molecules that can be used in the production of industrial chemicals. As such, modified cells and microorganisms provided herein are useful as platform systems that can be used for enhanced production of many different desired target molecules (e.g., terpenes) either singly or multiply in co-production microbial systems. Also provided herein are methods of modifying cellular carbon flux and methods of generating cells or microorganisms in which carbon flux has been optimized for production of target molecules, e.g., carbon-containing compounds, terpenes. Further provided herein are methods of producing target molecules (e.g., terpenes) using cell-based or microbial biosynthesis systems, including, for example, modified cells or microorganisms in which the flux of cellular carbon has been altered relative to an unmodified microorganism. Also provided are compositions, including, but not limited to, nucleic acids and chemical media and combinations, that can be used in the methods provided herein.

Terpenes

Provided herein are methods for producing terpenes and engineered cells and microorganisms capable of producing terpenes. Terpenes are compounds generally made from isoprene units $(C_5H_8)_n$. Isoprene, also known as 2-methyl-1,3-butadiene or 2-Methylbuta-1,3-diene, is an organic compound having the formula $CH_2=C(CH_3)-CH=CH_2$. Isoprene units may be assembled in various combinations to produce thousands of possible terpene compounds. Terpenes may include hemiterpenes (one isoprene unit), monoterpenes (two isoprene units), sesquiterpenes (three isoprene units), diterpenes (four isoprene units), sesterterpenes (five isoprene units), triterpenes (six isoprene units), sesquarterpenes (seven isoprene units), tetraterpenes (eight isoprene units), and polyterpenes (many isoprene units; more than eight isoprene units). Hemiterpenes may include, for example, isoprene, prenol, isovaleric acid, benzoate, and prenyl acetate. Monoterpenes may include, for example, α-ocimene, β-ocimene, α-myrcene, β-myrcene, geraniol, citronellal, citronellol, linalool, citral A, halomon, S-limonene, R-limonene, phellandrene, α-terpinene, menthol, S-carvone, R-carvone, safranal, terpineol, thymol, carvacrol, umbellulone, piperitone, pulegone, rose oxide, lactisole, sabinene, camphene, eucalyptol, thujene, thujone, pinene, nepetalactone, ascaridole, borneol, verbenone, camphor, ethyl fenchol, and cyclosantene. Sesquiterpenes may include, for example, farnesene, farnesol, nerolidol, zingiberene, humulene, bisabolane, bisabolene, elemol, caryophyllene, guaiol, vetivazulene, cadinene, caryophyllene, cuparane, laurene, laurane, oppositane, mutisianthol, thapsane, lepidozanes, chiloscyphane, pinguisanes, herbertanes, botrydial, ngaione, longifolene, copaene, patchoulol, norpatchoulenol, santalol, cortisol, progesterone, oestrogen, testosterone, and 11-ketotestosterone. Diterpenes may include, for example, phytol, cembrene A, retinol, retinal, labdane, abietic acid, ferruginol, tetrahydrocannabinol, forskolin, cafestol, and gibberellins. Sesterterpenes may include, for example, geranylfarnesol and amyrin. Triterpenes may include, for example, squalene, sapelenins, tangshenoside I, cholecalciferol, dihydrotachysterol, lanosterol, cholesterol, cycloartenol, lovastatin, cucurbitacin, 20-hydroxyecdysone, campesterol, stigmasterol, ergosterol, bile acids, betulinic acid, withaferin A, ginsenosides, eleutherosides, astragalosides, bacoside A, araloside A, ziziphin, and gymnemic acids. Tetraterpenes may include, for example, phytoene, phytofluene, lycopene, torulene, γ-carotene, δ-carotene, citranaxanthin, rubixanthin, α-carotene, β-carotene, astaxanthin, cryptoxanthins, canthaxanthin, violaxanthin, antheraxanthin, zeaxanthin, lutein, diadinoxanthin, diatoxanthin, neoxanthin, fucoxanthins and flavoxanthins. Polyterpenes may include, for example, polypropylene, rubber and latex.

Terpenes may include molecules containing only carbon (C) and hydrogen (H) atoms and also may include molecules containing carbon (C) and hydrogen (H) atoms in addition to other atoms (e.g. oxygen (O)). Terpene molecules containing atoms in addition to carbon (C) and hydrogen (H) may be referred to as terpenoids. In certain instances, compounds referred to as terpenoids contain only carbon (C) and hydrogen (H). Use of the term terpene herein includes terpenoids. Terpene structures may be acyclic (no carbon rings), monocyclic (one carbon ring), bicyclic (two carbon rings), tricyclic (three carbon rings), tetracyclic (four carbon rings), pentacyclic (five carbon rings), hexacyclic (six carbon rings), heptacyclic (seven carbon rings), or octacyclic (eight carbon rings). Terpene structures may contain more than eight carbon rings.

Terpenes may include carotenoids. Carotenoids (also referred to as tetraterpenoids) generally are pigments that provide red, orange, and yellow pigmentation to certain organisms, and include certain 40-carbon molecules. Over 700 carotenoids are known, which include, for example, carotenes (e.g., γ-carotene, β-carotene, α-carotene, ε-carotene, δ-carotene), xanthophylls (e.g., lutein, zeaxanthin, neoxanthin, violaxanthin, flavoxanthin, and α- and β-cryptoxanthin), torulene, lycopene, lutein epoxide, hydroxyechinenone, phoenicoxanthin, astaxanthin, fucoxanthin, 19'-butanoyloxyfucoxanthin, 19'-hexanoyloxyfucoxanthin, diatoxanthin, diadinoxanthin 19-hexanoyloxyparacentrone 3-acetate, gyroxanthin, canthaxanthin, citranaxanthin, and apo-caroten-ester. About 40 to 50 carotenoids can be found in food, and about 6 carotenoids can be found in human serum. Carotenoids may be synthesized de novo by organisms including, for example, archae, bacteria, fungi, algae, plants, aphids & spider mites. Carotenoids have various uses including, for example, antioxidants, color attractants, protection of plants from sun damage, precursors to vitamins, inflammatory disease protection, eye health, bone growth, and immune function.

Provided herein are microorganisms genetically modified to produce terpenes. For example, a genetically modified microorganism may comprise one or more heterologous nucleic acids encoding one or more terpene biosynthesis polypeptides. Terpene biosynthesis polypeptides may include any polypeptide capable of producing a terpene molecule or a terpene precursor. Terpene biosynthesis polypeptides may include one or more enzymes. For example, terpene biosynthesis polypeptides may include one or more of terpene synthase, phytoene synthase, geranylgeranyl diphosphate synthase, phytoene desaturase, lycopene cyclase, bifunctional lycopene cyclase/phytoene synthase, β-carotene ketolase, β-carotene hydroxylase, astaxanthin synthase, zeaxanthin glucosyltransferase, valencene synthase, and cytochrome p450 reductase. In some embodiments, a genetically modified microorganism comprises heterologous nucleic acids encoding one or more of phytoene synthase, geranylgeranyl diphosphate synthase and phytoene desaturase. In some embodiments, a genetically modified microorganism comprises heterologous nucleic acids encoding phytoene synthase, geranylgeranyl diphosphate synthase and phytoene desaturase. In some embodiments, a genetically modified microorganism comprises heterologous nucleic acids encoding one or more of geranylgeranyl diphosphate synthase, phytoene desaturase and bifunctional lycopene cyclase/phytoene synthase. In some embodiments, a genetically modified microorganism comprises heterologous nucleic acids encoding geranylgeranyl diphosphate synthase, phytoene desaturase and bifunctional lycopene cyclase/phytoene synthase. In some embodiments, a genetically modified microorganism comprises heterologous nucleic acids encoding one or more of geranylgeranyl diphosphate synthase, phytoene desaturase, lycopene cyclase, and phytoene synthase. In some embodiments, a genetically modified microorganism comprises heterologous nucleic acids encoding geranylgeranyl diphosphate synthase, phytoene desaturase, lycopene cyclase, and phytoene synthase. In some embodiments, a genetically modified microorganism comprises a heterologous nucleic acid encoding valencene synthase.

In some embodiments, a genetically modified microorganism comprises heterologous nucleic acids encoding one or more of geranylgeranyl diphosphate synthase, phytoene desaturase, bifunctional lycopene cyclase/phytoene synthase, β-carotene ketolase, β-carotene hydroxylase, astaxanthin synthase, and cytochrome p450 reductase. In some embodiments, a genetically modified microorganism comprises heterologous nucleic acids encoding geranylgeranyl diphosphate synthase, phytoene desaturase, bifunctional lycopene cyclase/phytoene synthase, β-carotene ketolase, β-carotene hydroxylase, astaxanthin synthase, and cytochrome p450 reductase. In some embodiments, a genetically modified microorganism comprises heterologous nucleic acids encoding one or more of geranylgeranyl diphosphate synthase, phytoene desaturase, lycopene cyclase, phytoene synthase, β-carotene ketolase, β-carotene hydroxylase, astaxanthin synthase, and cytochrome p450 reductase. In some embodiments, a genetically modified microorganism comprises heterologous nucleic acids encoding geranylgeranyl diphosphate synthase, phytoene desaturase, lycopene cyclase, phytoene synthase, β-carotene ketolase, β-carotene hydroxylase, astaxanthin synthase, and cytochrome p450 reductase.

Terpene biosynthesis polypeptides may include any polypeptide (e.g., enzyme) capable of producing a terpene precursor. In certain embodiments, terpene biosynthesis polypeptides include one or more polypeptides (e.g., enzymes) in a mevalonate pathway (e.g., upper mevalonate pathway, lower mevalonate pathway). Typically, a mevalonate pathway begins with cytoplasmic acetyl-CoA, and the end product of a mevalonate pathway is isopentenyl diphosphate (IPP), which can serve as a monomer unit for terpene production. Polypeptides (e.g., enzymes) in a mevalonate pathway may include, for example, one or more of acetyl-CoA C-acetyltransferase, HMG-CoA synthase, HMG-CoA reductase, mevalonate kinase, phosphomevalonate kinase, diphosphomevalonate decarboxylase, isopentyl diphosphate delta isomerase, dimethylallyltranstransferase, and farnesyl diphosphate synthetase. In some embodiments, amounts and/or activities of one or more proteins chosen from acetyl-CoA C-acetyltransferase, HMG-CoA synthase, HMG-CoA reductase, mevalonate kinase, phosphomevalonate kinase, diphosphomevalonate decarboxylase, isopentyl diphosphate delta isomerase, dimethylallyltranstransferase, and farnesyl diphosphate synthetase are increased in a genetically modified microorganism provided herein. In some embodiments, a genetically modified microorganism comprises heterologous nucleic acids encoding one or more of acetyl-CoA C-acetyltransferase, HMG-CoA synthase, HMG-CoA reductase, mevalonate kinase, phosphomevalonate kinase, diphosphomevalonate decarboxylase, isopentyl diphosphate delta isomerase, dimethylallyltranstransferase, and farnesyl diphosphate synthetase.

In some embodiments, a heterologous nucleic acid encoding a terpene biosynthesis polypeptide is endogenously expressed in a microorganism that is different from the microorganism genetically modified to produce terpenes. In some embodiments, a heterologous nucleic acid encoding a terpene biosynthesis polypeptide is endogenously expressed in a microorganism that is of a different species, genus, family, order, class, phylum or kingdom than the microorganism genetically modified to produce terpenes. For example, a heterologous nucleic acid encoding a terpene biosynthesis polypeptide may be endogenously expressed in a microorganism chosen from *Cronobacter* spp, *Callitropsis* spp, *Xanthophyllomyces* spp, *Agrobacterium* spp, and *Pantoea* spp.

A heterologous nucleic acid encoding a terpene biosynthesis polypeptide may include an endogenous nucleic acid linked to a promoter or other regulatory element that is not normally functionally linked to the endogenous nucleic acid sequence. Promoters may include, for example, a mutated form of an endogenous promoter, an endogenous promoter replaced with a modified version of the endogenous promoter, and an endogenous promoter replaced with a promoter located elsewhere in the same genome or from a different genome. A modification may be performed by directed mutagenesis, and the mutated promoter may be referred to as "heterologous" because it is no longer native. In certain instances, a modification may be performed by replacing an endogenous promoter with a modified promoter, the latter of which would be considered heterologous because the modified promoter is not normally functionally linked to an endogenous nucleic acid.

In some embodiments, a heterologous nucleic acid encoding a terpene biosynthesis polypeptide is regulated according to an inducible system. For example, a heterologous nucleic acid encoding a terpene biosynthesis polypeptide may be regulated by a nucleic acid that provides for fatty acid induction of expression of the terpene biosynthesis polypeptide. The fatty acid that can induce expression of a terpene biosynthesis polypeptide may be a saturated fatty acid or an unsaturated fatty acid. For example, a fatty acid may be chosen from one or more of oleic acid, palmitoleic acid, erucic acid, linoleic acid, palmitic acid, caproic acid, enanthic acid, caprylic acid pelargonic acid, capric acid, undecylic acid, lauric acid, myristic acid, pentadecanoic acid, margaric acid, stearic acid arachidic acid, behenic acid, tridecylic acid, and linolenic acid.

In some embodiments, a nucleic acid that provides for fatty acid induction of expression of a terpene biosynthesis polypeptide is a promoter or a portion of a promoter. In some embodiments, a nucleic acid that provides for fatty acid induction of expression of a terpene biosynthesis polypeptide comprises a fatty acid response element. In some embodiments, a nucleic acid that provides for fatty acid induction of expression of a terpene biosynthesis polypeptide is a promoter, or a portion of a promoter, comprising a fatty acid response element. In some embodiments, a fatty acid response element comprises an oleic acid response element. In some embodiments, a nucleic acid that provides for fatty acid induction of expression of a terpene biosynthesis polypeptide comprises a promoter region of a heterologous gene. In some embodiments, a nucleic acid that provides for fatty acid induction of expression of a terpene biosynthesis polypeptide comprises a promoter region of an endogenous gene. For example, a promoter region may be a promoter region of a gene encoding hydratase-dehydrogenase-epimerase (HDE), acyl co-A oxidase (POX; e.g., POX4), acyl co-A thiolase (POT), peroxin (PEX), peroxisomal protein POX18, or peroxisomal adenine nucleotide transporter protein (ANT1). In some embodiments, a nucleic acid that provides for fatty acid induction of expression of a terpene biosynthesis polypeptide comprises a promoter region of a gene encoding hydratase-dehydrogenase-epimerase (HDE).

In some embodiments, a nucleic acid that provides for fatty acid induction of expression of a terpene biosynthesis polypeptide comprises a promoter region of a gene from *Candida*. For example, a promoter region may be a promoter region of a gene encoding *Candida* hydratase-dehydrogenase-epimerase (HDE), *Candida* acyl co-A oxidase (POX; e.g., POX4), *Candida* acyl co-A thiolase (POT), *Candida* peroxin (PEX), peroxisomal protein POX18, or *Candida* peroxisomal adenine nucleotide transporter protein (ANT1). In some embodiments, a nucleic acid that provides for fatty acid induction of expression of a terpene biosynthesis polypeptide comprises a promoter region of a gene encoding *Candida* hydratase-dehydrogenase-epimerase (HDE).

In some embodiments, a heterologous nucleic acid encoding a terpene biosynthesis polypeptide is regulated by a nucleic acid that provides for alkane induction of expression of the terpene biosynthesis polypeptide. An alkane may be chosen from one or more of hexane, heptane, nonane, decane, undecane, dodecane, tridecane, tetradecane, pentadecane, hexadecane, heptadecane, and octadecane, for example. In some embodiments, a nucleic acid that provides for alkane induction of expression of a terpene biosynthesis polypeptide is a promoter or a portion of a promoter. In some embodiments, a nucleic acid that provides for alkane induction of expression of a terpene biosynthesis polypeptide comprises an alkane response element. In some embodiments, a nucleic acid that provides for alkane induction of expression of a terpene biosynthesis polypeptide is a promoter, or a portion of a promoter, comprising an alkane response element. In some embodiments, an alkane response element comprises an alkane response element 1 (ARE1) sequence or an ARE1-like sequence as described herein. In some embodiments, a nucleic acid that provides for alkane induction of expression of a terpene biosynthesis polypeptide comprises a promoter region, or a portion of a promoter region, of a heterologous gene.

In some embodiments, a heterologous nucleic acid encoding a terpene biosynthesis polypeptide is regulated by a nucleic acid that provides for glucose induction of expression of the terpene biosynthesis polypeptide. In some embodiments, a nucleic acid that provides for glucose induction of expression of a terpene biosynthesis polypeptide comprises a promoter region of a gene encoding glyceraldehyde-3-phosphate dehydrogenase (GPD). In some embodiments, a nucleic acid that provides for glucose induction of expression of a terpene biosynthesis polypeptide comprises a promoter region of a gene from *Candida*. In some embodiments, a nucleic acid that provides for glucose induction of expression of a terpene biosynthesis polypeptide comprises a promoter region of a gene encoding *Candida* glyceraldehyde-3-phosphate dehydrogenase (GPD).

Modification of an Acetyl-CoA C-Acetyltransferase Activity

An initial step in the upper mevalonate pathway is the conversion of 2 acetyl-CoA molecules to acetoacetyl-CoA and CoA. An acetyl-CoA C-acetyltransferase enzyme (also referred to as ERG10, acetoacetyl-CoA thiolase, acetyl-CoA acetyltransferase, ergosterol biosynthesis protein 10, beta-acetoacetyl coenzyme A thiolase, 2-methylacetoacetyl-CoA thiolase, 3-oxothiolase, acetyl coenzyme A thiolase, acetyl-CoA:N-acetyltransferase, thiolase II, LPB3, TSM0115; EC 2.3.1.9) is a cytosolic and/or peroxisomal enzyme that can transfer an acetyl group from one acetyl-CoA molecule to another, forming acetoacetyl-CoA. In some embodiments of the cells, organisms, compositions and methods provided herein, the amount and/or activity of an acetyl-CoA C-acetyltransferase in a cell is modified. For example, in some aspects, a cell or microorganism may be modified to increase the amount and/or activity of an acetyl-CoA C-acetyltransferase, may be modified to decrease the amount and/or activity of an acetyl-CoA C-acetyltransferase, or may be modified to alternately increase and decrease the amount and/or activity of an acetyl-CoA C-acetyltransferase depending, for example, on the cellular location(s) of the enzyme and/or on the conditions in which the modified cell or microorganism is cultured.

In certain aspects, the amount and/or activity of an acetyl-CoA C-acetyltransferase in a cell is increased. Increasing the amount and/or activity of an acetyl-CoA C-acetyltransferase may be particularly beneficial in embodiments in which the flux of carbons from fatty acids is directed toward a particular target product pathway (e.g., mevalonate production, isopentenyl diphosphate production, geranyl diphosphate production, farnesyl diphosphate production, geranylgeranyl diphosphate production, terpene production, carotenoid production, beta carotene production, lycopene production, astaxanthin production) and away from other cellular metabolic pathways not involved in target molecule production.

In certain embodiments, acetyl-CoA C-acetyltransferase activity is unchanged in a host or engineered cell or organism. In some embodiments, the amount and/or activity of a host acetyl-CoA C-acetyltransferase can be increased by increasing the number of copies of a nucleic acid encoding an acetyl-CoA C-acetyltransferase (e.g., 1, 2, 3, 4, 5, 6, 7, 8, 9, 10, 15, 20, 25 or more copies of the nucleic acid); by increasing the activity of a promoter that regulates transcription of a nucleic acid encoding an acetyl-CoA C-acetyltransferase; or by increasing the number of copies of a nucleic acid encoding an acetyl-CoA C-acetyltransferase and increasing the activity of a promoter that regulates transcription of a nucleic acid encoding an acetyl-CoA C-acetyltransferase. In some embodiments, an acetyl-CoA C-acetyltransferase is endogenous to the host cell or microorganism. In one aspect of the cell or microbial systems and methods provided herein, the amount of acetyl-CoA C-acetyltransferase protein expressed in a cell can be increased by introducing heterologous nucleic acid encoding an acetyl-CoA C-acetyltransferase into a cell or microorganism. For example, introduction of heterologous nucleic acid encoding an acetyl-CoA C-acetyltransferase can result in increased copy number of such nucleic acids and/or provide for modification of the cellular location in which the protein is expressed.

In some embodiments, an acetyl-CoA C-acetyltransferase enzyme can be a fungal or bacterial protein. In a particular embodiment, the acetyl-CoA C-acetyltransferase enzyme can be a *Candida* (e.g., *C. tropicalis*, *C. viswanathii*, *C. maltosa*, *C. cloacae*), *Yarrowia* (e.g., *Y. lipolytica*), *Fusarium* (e.g., *F. oxysporum*), *Bacillus* (e.g., *B. megaterium*, *B. subtilis*), *Chronobacter* (e.g., *C. sakazakii*), *Xanthophyllomyces* (e.g., *X. dendrorhous*), or *Pantoea* (e.g., *P. ananatis*) protein. An example of a *Candida viswanathii* nucleotide sequence (SEQ ID NO: 371) encoding a polypeptide (ERG10; SEQ ID NO: 337) having an acetyl-CoA C-acetyltransferase activity is provided herein. Additional nonlimiting examples of nucleotide sequences encoding polypeptides having acetyl-CoA C-acetyltransferase activity include: *Candida tropicalis* CTPACTB gene for acetoacetyl-CoA thiolase A (Genbank accession no. D13471.1), *Candida tropicalis* CTPACTA gene for acetoacetyl-CoA thiolase A (Genbank accession no. D13470.1), and *Candida tropicalis* MYA-3404 acetyl-CoA acetyltransferase IB (NCBI Reference Sequence: XM_002547232.1).

Presence, absence or amount of acetyl-CoA C-acetyltransferase activity can be detected by any suitable method known in the art. For example, detection can be performed by using an acetyltransferase activity kit (e.g., ENZO, ADI-907-026). Nucleic acid sequences encoding native and/or modified acetyl-CoA C-acetyltransferase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding an acetyl-CoA C-acetyltransferase can be modified. For example, the amount of an acetyl-CoA C-acetyltransferase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of acetyl-CoA C-acetyltransferase expression by a carbon source or feedstock include RT-PCR or qRT-PCR after the host cell or microorganism has been exposed to the chosen carbon source or feedstock for varying amounts of time.

Decreasing acetyl-CoA C-acetyltransferase activity in a cell can be accomplished by modifying the amount of acetyl-CoA C-acetyltransferase protein expression in the cell, for example, by replacing the wild-type promoter of an endogenous acetyl-CoA C-acetyltransferase gene in a cell or organism with a weaker heterologous promoter, deleting or disrupting an endogenous gene, and/or replacing or modifying a gene encoding a wild-type acetyl-CoA C-acetyltransferase such that the encoded modified or substituted acetyl-CoA C-acetyltransferase protein has a reduced enzyme activity.

Modification of an HMG-CoA Synthase Activity

A further step in the upper mevalonate pathway is the reaction in which acetyl-CoA condenses with acetoacetyl-CoA to form 3-hydroxy-3-methylglutaryl-CoA (HMG-CoA). An HMG-CoA synthase enzyme (also referred to as ERG13, hydroxymethylglutaryl-CoA synthase, (S)-3-hydroxy-3-methylglutaryl-CoA acetoacetyl-CoA-lyase, (CoA-acetylating), 3-hydroxy-3-methylglutaryl CoA synthetase, 3-hydroxy-3-methylglutaryl coenzyme A synthase, 3-hydroxy-3-methylglutaryl coenzyme A synthetase, 3-hydroxy-3-methylglutaryl-CoA synthase, 3-hydroxy-3-methylglutaryl-coenzyme A synthase, beta-hydroxy-beta-methylglutaryl-CoA synthase, acetoacetyl coenzyme A transacetase, hydroxymethylglutaryl coenzyme A synthase, and hydroxymethylglutaryl coenzyme A-condensing enzyme; EC 2.3.3.10) contains a catalytic cysteine residue that acts as a nucleophile in the acetylation of the enzyme by acetyl-CoA (first substrate) to produce an acetyl-enzyme thioester, releasing the reduced coenzyme A. A subsequent nucleophilic attack on acetoacetyl-CoA (second substrate) forms HMG-CoA. In some embodiments of the cells, organisms, compositions and methods provided herein, the amount and/or activity of an HMG-CoA synthase in a cell is modified. For example, in some aspects, a cell or microorganism may be modified to increase the amount and/or activity of an HMG-CoA synthase, may be modified to decrease the amount and/or activity of an HMG-CoA synthase, or may be modified to alternately increase and decrease the amount and/or activity of an HMG-CoA synthase depending, for example, on the cellular location(s) of the enzyme and/or on the conditions in which the modified cell or microorganism is cultured.

In certain aspects, the amount and/or activity of an HMG-CoA synthase in a cell is increased. Increasing the amount and/or activity of an HMG-CoA synthase may be particularly beneficial in embodiments in which the flux of carbons from fatty acids is directed toward a particular target product pathway (e.g., mevalonate production, isopentenyl diphosphate production, geranyl diphosphate production, farnesyl diphosphate production, geranylgeranyl diphosphate production, terpene production, carotenoid production, beta carotene production, lycopene production, astaxanthin production) and away from other cellular metabolic pathways not involved in target molecule production.

In certain embodiments, HMG-CoA synthase activity is unchanged in a host or engineered cell or organism. In some embodiments, the amount and/or activity of a host HMG-CoA synthase can be increased by increasing the number of copies of a nucleic acid encoding an HMG-CoA synthase (e.g., 1, 2, 3, 4, 5, 6, 7, 8, 9, 10, 15, 20, 25 or more copies of the nucleic acid); by increasing the activity of a promoter that regulates transcription of a nucleic acid encoding an HMG-CoA synthase; or by increasing the number of copies of a nucleic acid encoding an HMG-CoA synthase and increasing the activity of a promoter that regulates transcription of a nucleic acid encoding an HMG-CoA synthase. In some embodiments, an HMG-CoA synthase is endogenous to the host cell or microorganism. In one aspect of the cell or microbial systems and methods provided herein, the amount of HMG-CoA synthase protein expressed in a cell can be increased by introducing heterologous nucleic acid encoding an HMG-CoA synthase into a cell or microorganism. For example, introduction of heterologous nucleic acid encoding an HMG-CoA synthase can result in increased copy number of such nucleic acids and/or provide for modification of the cellular location in which the protein is expressed.

In some embodiments, an HMG-CoA synthase enzyme can be a fungal or bacterial protein. In a particular embodiment, the HMG-CoA synthase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), or *Pantoea* (e.g., *P. ananatis*) protein. An example of a *Candida viswanathii* nucleotide sequence (SEQ ID NO: 372) encoding a polypeptide (ERG13; SEQ ID NO: 338) having an HMG-CoA synthase is provided herein. Additional nonlimiting examples of nucleotide sequences encoding polypeptides having HMG-CoA synthase activity include: *Candida tropicalis* MYA-3404 hydroxymethylglutaryl-CoA synthase (NCBI Reference Sequence: XM_002546412.1), and *Candida tanzawaensis* NRRL Y-17324 hydroxymethylglutaryl-CoA synthase (NCBI Reference Sequence: XM_020207398.1).

Presence, absence or amount of HMG-CoA synthase activity can be detected by any suitable method known in the art. For example, detection can be performed by using a visible wavelength spectrophotometric assay for HMG-CoA synthase (see e.g., Skaff et al. (2010) Anal. Biochem. 396 (1):96-102). Nucleic acid sequences encoding native and/or modified HMG-CoA synthase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding an HMG-CoA synthase can be modified. For example, the amount of an HMG-CoA synthase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of HMG-CoA synthase expression by a carbon source or feedstock include RT-PCR or qRT-PCR after the host cell or microorganism has been exposed to the chosen carbon source or feedstock for varying amounts of time.

Decreasing HMG-CoA synthase activity in a cell can be accomplished by modifying the amount of HMG-CoA synthase protein expression in the cell, for example, by replacing the wild-type promoter of an endogenous HMG-CoA synthase gene in a cell or organism with a weaker heterologous promoter, deleting or disrupting an endogenous gene, and/or replacing or modifying a gene encoding a wild-type HMG-CoA synthase such that the encoded modified or substituted HMG-CoA synthase protein has a reduced enzyme activity.

Modification of an HMG-CoA Reductase Activity

A further (rate controlling) step in the upper mevalonate pathway is the conversion of HMG-CoA to mevalonate by HMG-CoA reductase. HMG-CoA reductase (EC 1.1.1.34) may also be referred to as HMG1, 3-hydroxy-3-methylglutaryl-coenzyme A reductase, HMGCR, LDLCQ3, 3-hydroxy-3-methylglutaryl-CoA reductase, and hydroxymethylglutaryl-CoA reductase. In some embodiments of the cells, organisms, compositions and methods provided herein, the amount and/or activity of an HMG-CoA reductase in a cell is modified. For example, in some aspects, a cell or microorganism may be modified to increase the amount and/or activity of an HMG-CoA reductase, may be modified to decrease the amount and/or activity of an HMG-CoA reductase, or may be modified to alternately increase and decrease the amount and/or activity of an HMG-CoA reductase depending, for example, on the cellular location(s) of the enzyme and/or on the conditions in which the modified cell or microorganism is cultured.

In certain aspects, the amount and/or activity of an HMG-CoA reductase in a cell is increased. Increasing the amount and/or activity of an HMG-CoA reductase may be particularly beneficial in embodiments in which the flux of carbons from fatty acids is directed toward a particular target product pathway (e.g., mevalonate production, isopentenyl diphosphate production, geranyl diphosphate production, farnesyl diphosphate production, geranylgeranyl diphosphate production, terpene production, carotenoid production, beta carotene production, lycopene production, astaxanthin production) and away from other cellular metabolic pathways not involved in target molecule production.

In certain embodiments, HMG-CoA reductase activity is unchanged in a host or engineered cell or organism. In some embodiments, the amount and/or activity of a host HMG-CoA reductase can be increased by increasing the number of copies of a nucleic acid encoding an HMG-CoA reductase (e.g., 1, 2, 3, 4, 5, 6, 7, 8, 9, 10, 15, 20, 25 or more copies of the nucleic acid); by increasing the activity of a promoter that regulates transcription of a nucleic acid encoding an HMG-CoA reductase; or by increasing the number of copies of a nucleic acid encoding an HMG-CoA reductase and increasing the activity of a promoter that regulates transcription of a nucleic acid encoding an HMG-CoA reductase. In some embodiments, an HMG-CoA reductase is endogenous to the host cell or microorganism. In one aspect of the cell or microbial systems and methods provided herein, the amount of HMG-CoA reductase protein expressed in a cell can be increased by introducing heterologous nucleic acid encoding an HMG-CoA reductase into a cell or microorganism. For example, introduction of heterologous nucleic acid encoding an HMG-CoA reductase can result in increased copy number of such nucleic acids and/or provide for modification of the cellular location in which the protein is expressed.

In some embodiments, an HMG-CoA reductase enzyme can be a fungal or bacterial protein. In a particular embodiment, the HMG-CoA reductase enzyme can be a *Candida* (e.g., *C. tropicalis*, *C. viswanathii*, *C. maltosa*, *C. cloacae*), *Yarrowia* (e.g., *Y. lipolytica*), *Fusarium* (e.g., *F. oxysporum*), *Bacillus* (e.g., *B. megaterium*, *B. subtilis*), Chronobacter (e.g., *C. sakazakii*), *Xanthophyllomyces* (e.g., *X. dendrorhous*), or *Pantoea* (e.g., *P. ananatis*) protein. An example of a *Candida viswanathii* nucleotide sequence (SEQ ID NO: 373) encoding a polypeptide (HMG1; SEQ ID NO: 339) having an HMG-CoA reductase activity is provided herein. An additional nonlimiting example of a nucleotide sequence encoding a polypeptide having HMG-CoA reductase activity includes: *Candida tropicalis* MYA-3404 3-hydroxy-3-methylglutaryl-coenzyme A reductase (NCBI Reference Sequence: XM_002550004.1).

Presence, absence or amount of HMG-CoA reductase activity can be detected by any suitable method known in the art. For example, detection can be performed by using an HMG-CoA Reductase Assay Kit (e.g., SIGMA-ALDRICH, CS1090 Sigma); and/or a Colorimetric HMG-CoA Reductase Activity Assay Kit (ABCAM, ab204701). Nucleic acid sequences encoding native and/or modified HMG-CoA reductase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding an HMG-CoA reductase can be modified. For example, the amount of an HMG-CoA reductase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of HMG-CoA reductase expression by a carbon source or feedstock include RT-PCR or qRT-PCR after the host cell or microorganism has been exposed to the chosen carbon source or feedstock for varying amounts of time.

Decreasing HMG-CoA reductase activity in a cell can be accomplished by modifying the amount of HMG-CoA reductase protein expression in the cell, for example, by replacing the wild-type promoter of an endogenous HMG-CoA reductase gene in a cell or organism with a weaker heterologous promoter, deleting or disrupting an endogenous gene, and/or replacing or modifying a gene encoding a wild-type HMG-CoA reductase such that the encoded modified or substituted HMG-CoA reductase protein has a reduced enzyme activity.

Modification of a Mevalonate Kinase Activity

The initial step in the lower mevalonate pathway is the conversion of mevalonate to phosphomevalonate by mevalonate kinase. Mevalonate kinase (EC 2.7.1.36) may also be referred to as ERG12, MVK, LRBP, MK, MVLK, and POROK3. In some embodiments of the cells, organisms, compositions and methods provided herein, the amount and/or activity of a mevalonate kinase in a cell is modified. For example, in some aspects, a cell or microorganism may be modified to increase the amount and/or activity of a mevalonate kinase, may be modified to decrease the amount and/or activity of a mevalonate kinase, or may be modified to alternately increase and decrease the amount and/or activity of a mevalonate kinase depending, for example, on the cellular location(s) of the enzyme and/or on the conditions in which the modified cell or microorganism is cultured.

In certain aspects, the amount and/or activity of a mevalonate kinase in a cell is increased. Increasing the amount and/or activity of a mevalonate kinase may be particularly beneficial in embodiments in which the flux of carbons from fatty acids is directed toward a particular target product pathway (e.g., isopentenyl diphosphate production, geranyl diphosphate production, farnesyl diphosphate production, geranylgeranyl diphosphate production, terpene production, carotenoid production, beta carotene production, lycopene production, astaxanthin production) and away from other cellular metabolic pathways not involved in target molecule production.

In certain embodiments, mevalonate kinase activity is unchanged in a host or engineered cell or organism. In some embodiments, the amount and/or activity of a host mevalonate kinase can be increased by increasing the number of copies of a nucleic acid encoding a mevalonate kinase (e.g., 1, 2, 3, 4, 5, 6, 7, 8, 9, 10, 15, 20, 25 or more copies of the nucleic acid); by increasing the activity of a promoter that regulates transcription of a nucleic acid encoding a mevalonate kinase; or by increasing the number of copies of a nucleic acid encoding a mevalonate kinase and increasing the activity of a promoter that regulates transcription of a nucleic acid encoding a mevalonate kinase. In some embodiments, a mevalonate kinase is endogenous to the host cell or microorganism. In one aspect of the cell or microbial systems and methods provided herein, the amount of mevalonate kinase protein expressed in a cell can be increased by introducing heterologous nucleic acid encoding a mevalonate kinase into a cell or microorganism. For example, introduction of heterologous nucleic acid encoding a mevalonate kinase can result in increased copy number of such nucleic acids and/or provide for modification of the cellular location in which the protein is expressed.

In some embodiments, a mevalonate kinase enzyme can be a fungal or bacterial protein. In a particular embodiment, the mevalonate kinase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), or *Pantoea* (e.g., *P. ananatis*) protein. An example of a *Candida viswanathii* nucleotide sequence (SEQ ID NO: 374) encoding a polypeptide (ERG12; SEQ ID NO: 340) having a mevalonate kinase activity is provided herein.

Presence, absence or amount of mevalonate kinase activity can be detected by any suitable method known in the art. For example, detection can be performed by using a mevalonate kinase assay (see e.g., Green et al. (1970) Anal. Biochem. 38(1):130-138; Gibson et al. (1989) Enzyme 41(1):47-55). Nucleic acid sequences encoding native and/or modified mevalonate kinase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a mevalonate kinase can be modified. For example, the amount of a mevalonate kinase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of mevalonate kinase expression by a carbon source or feedstock include RT-PCR or qRT-PCR after the host cell or microorganism has been exposed to the chosen carbon source or feedstock for varying amounts of time.

Decreasing mevalonate kinase activity in a cell can be accomplished by modifying the amount of mevalonate kinase protein expression in the cell, for example, by replacing the wild-type promoter of an endogenous mevalonate kinase gene in a cell or organism with a weaker heterologous promoter, deleting or disrupting an endogenous gene, and/or replacing or modifying a gene encoding a wild-type mevalonate kinase such that the encoded modified or substituted mevalonate kinase protein has a reduced enzyme activity.

Modification of a Phosphomevalonate Kinase Activity

A further step in the lower mevalonate pathway is the conversion of phosphomevalonate to di phosphomevalonate (mevalonate-5-phosphate to mevalonate-5-pyrophosphate; 5-phosphomevalonate to 5-diphosphomevalonate) by phosphomevalonate kinase. Phosphomevalonate kinase (ERG8; EC 2.7.4.2) may also be referred to as 5-phosphomevalonate phosphotransferase and PMVK. In some embodiments of the cells, organisms, compositions and methods provided herein, the amount and/or activity of a phosphomevalonate kinase in a cell is modified. For example, in some aspects, a cell or microorganism may be modified to increase the amount and/or activity of a phosphomevalonate kinase, may be modified to decrease the amount and/or activity of a phosphomevalonate kinase, or may be modified to alternately increase and decrease the amount and/or activity of a phosphomevalonate kinase depending, for example, on the cellular location(s) of the enzyme and/or on the conditions in which the modified cell or microorganism is cultured.

In certain aspects, the amount and/or activity of a phosphomevalonate kinase in a cell is increased. Increasing the amount and/or activity of a phosphomevalonate kinase may be particularly beneficial in embodiments in which the flux of carbons from fatty acids is directed toward a particular target product pathway (e.g., isopentenyl diphosphate production, geranyl diphosphate production, farnesyl diphosphate production, geranylgeranyl diphosphate production, terpene production, carotenoid production, beta carotene production, lycopene production, astaxanthin production) and away from other cellular metabolic pathways not involved in target molecule production.

In certain embodiments, phosphomevalonate kinase activity is unchanged in a host or engineered cell or organism. In some embodiments, the amount and/or activity of a host phosphomevalonate kinase can be increased by increasing the number of copies of a nucleic acid encoding a phosphomevalonate kinase (e.g., 1, 2, 3, 4, 5, 6, 7, 8, 9, 10, 15, 20, 25 or more copies of the nucleic acid); by increasing the activity of a promoter that regulates transcription of a nucleic acid encoding a phosphomevalonate kinase; or by increasing the number of copies of a nucleic acid encoding a phosphomevalonate kinase and increasing the activity of a promoter that regulates transcription of a nucleic acid encoding a phosphomevalonate kinase. In some embodiments, a phosphomevalonate kinase is endogenous to the host cell or microorganism. In one aspect of the cell or microbial systems and methods provided herein, the amount of phosphomevalonate kinase protein expressed in a cell can be increased by introducing heterologous nucleic acid encoding a phosphomevalonate kinase into a cell or microorganism. For example, introduction of heterologous nucleic acid encoding an phosphomevalonate kinase can result in increased copy number of such nucleic acids and/or provide for modification of the cellular location in which the protein is expressed.

In some embodiments, a phosphomevalonate kinase enzyme can be a fungal or bacterial protein. In a particular embodiment, the phosphomevalonate kinase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), or *Pantoea* (e.g., *P. ananatis*) protein. An example of a *Candida viswanathii* nucleotide sequence (SEQ ID NO: 375) encoding a polypeptide (ERG8; SEQ ID NO: 341) having a phosphomevalonate kinase activity is provided herein.

Presence, absence or amount of phosphomevalonate kinase activity can be detected by any suitable method known in the art. For example, detection can be performed by using a microplate assay for phosphomevalonate kinase activity (see e.g., Schulte et al. (1999) Anal. Biochem. 269(2):245-54). Nucleic acid sequences encoding native and/or modified phosphomevalonate kinase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a phosphomevalonate kinase can be modified. For example, the amount of a phosphomevalonate kinase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of phosphomevalonate kinase expression by a carbon source or feedstock include RT-PCR or qRT-PCR after the host cell or microorganism has been exposed to the chosen carbon source or feedstock for varying amounts of time.

Decreasing phosphomevalonate kinase activity in a cell can be accomplished by modifying the amount of phosphomevalonate kinase protein expression in the cell, for example, by replacing the wild-type promoter of an endogenous phosphomevalonate kinase gene in a cell or organism with a weaker heterologous promoter, deleting or disrupting an endogenous gene, and/or replacing or modifying a gene encoding a wild-type phosphomevalonate kinase such that the encoded modified or substituted phosphomevalonate kinase protein has a reduced enzyme activity.

Modification of a Diphosphomevalonate Decarboxylase Activity

A further step in the lower mevalonate pathway is the conversion of mevalonate 5-diphosphate (diphosphomevalonate; mevalonate-5-pyrophosphate; 5-diphosphomevalonate) to isopentenyl diphosphate. A diphosphomevalonate decarboxylase enzyme (also referred to as MVD1, ERG19, pyrophosphomevalonate decarboxylase, mevalonate-5-pyrophosphate decarboxylase, pyrophosphomevalonic acid decarboxylase, 5-pyrophosphomevalonate decarboxylase, mevalonate 5-diphosphate decarboxylase, and ATP:(R)-5-diphosphomevalonate carboxy-lyase (dehydrating); EC 4.1.1.33) can convert mevalonate 5-diphosphate to isopentenyl diphosphate through ATP dependent decarboxylation. In some embodiments of the cells, organisms, compositions and methods provided herein, the amount and/or activity of a diphosphomevalonate decarboxylase in a cell is modified. For example, in some aspects, a cell or microorganism may be modified to increase the amount and/or activity of a diphosphomevalonate decarboxylase, may be modified to decrease the amount and/or activity of a diphosphomevalonate decarboxylase, or may be modified to alternately increase and decrease the amount and/or activity of a diphosphomevalonate decarboxylase depending, for example, on the cellular location(s) of the enzyme and/or on the conditions in which the modified cell or microorganism is cultured.

In certain aspects, the amount and/or activity of a diphosphomevalonate decarboxylase in a cell is increased. Increasing the amount and/or activity of a diphosphomevalonate decarboxylase may be particularly beneficial in embodiments in which the flux of carbons from fatty acids is directed toward a particular target product pathway (e.g., isopentenyl diphosphate production, geranyl diphosphate production, farnesyl diphosphate production, geranylgeranyl diphosphate production, terpene production, carotenoid production, beta carotene production, lycopene production, astaxanthin production) and away from other cellular metabolic pathways not involved in target molecule production.

In certain embodiments, diphosphomevalonate decarboxylase activity is unchanged in a host or engineered cell or organism. In some embodiments, the amount and/or activity of a host diphosphomevalonate decarboxylase can be increased by increasing the number of copies of a nucleic acid encoding a diphosphomevalonate decarboxylase (e.g., 1, 2, 3, 4, 5, 6, 7, 8, 9, 10, 15, 20, 25 or more copies of the nucleic acid); by increasing the activity of a promoter that regulates transcription of a nucleic acid encoding a diphosphomevalonate decarboxylase; or by increasing the number of copies of a nucleic acid encoding a diphosphomevalonate decarboxylase and increasing the activity of a promoter that regulates transcription of a nucleic acid encoding a diphosphomevalonate decarboxylase. In some embodiments, a diphosphomevalonate decarboxylase is endogenous to the host cell or microorganism. In one aspect of the cell or microbial systems and methods provided herein, the amount of diphosphomevalonate decarboxylase protein expressed in a cell can be increased by introducing heterologous nucleic acid encoding a diphosphomevalonate decarboxylase into a cell or microorganism. For example, introduction of heterologous nucleic acid encoding a diphosphomevalonate decarboxylase can result in increased copy number of such nucleic acids and/or provide for modification of the cellular location in which the protein is expressed.

In some embodiments, a diphosphomevalonate decarboxylase enzyme can be a fungal or bacterial protein. In a particular embodiment, the diphosphomevalonate decarboxylase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), or *Pantoea* (e.g., *P. ananatis*) protein. An example of a *Candida viswanathii* nucleotide sequence (SEQ ID NO: 376) encoding a polypeptide (MVD1 (ERG19); SEQ ID NO: 342) having a diphosphomevalonate decarboxylase activity is provided herein. Additional nonlimiting examples of nucleotide sequences encoding polypeptides having diphosphomevalonate decarboxylase activity include: *Candida tropicalis* MYA-3404 diphosphomevalonate decarboxylase (NCBI Reference Sequence: XM_002549937.1) and *Candida tan-*

*zawaensis* NRRL Y-17324 Diphosphomevalonate decarboxylase (NCBI Reference Sequence: XM_020210701.1).

Presence, absence or amount of diphosphomevalonate decarboxylase activity can be detected by any suitable method known in the art. Nucleic acid sequences encoding native and/or modified diphosphomevalonate decarboxylase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a diphosphomevalonate decarboxylase can be modified. For example, the amount of a diphosphomevalonate decarboxylase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of diphosphomevalonate decarboxylase expression by a carbon source or feedstock include RT-PCR or qRT-PCR after the host cell or microorganism has been exposed to the chosen carbon source or feedstock for varying amounts of time.

Decreasing diphosphomevalonate decarboxylase activity in a cell can be accomplished by modifying the amount of diphosphomevalonate decarboxylase protein expression in the cell, for example, by replacing the wild-type promoter of an endogenous diphosphomevalonate decarboxylase gene in a cell or organism with a weaker heterologous promoter, deleting or disrupting an endogenous gene, and/or replacing or modifying a gene encoding a wild-type diphosphomevalonate decarboxylase such that the encoded modified or substituted diphosphomevalonate decarboxylase protein has a reduced enzyme activity.

Modification of an Isopentenyl Diphosphate Delta Isomerase Activity

A further step in the lower mevalonate pathway is the conversion of isopentenyl diphosphate (isopentenyl pyrophosphate, IPP) to dimethylallyl diphosphate (dimethylallyl pyrophosphate, DMAPP). An isopentenyl diphosphate delta isomerase enzyme (also referred to as IDI1, isopentenyl pyrophosphate isomerase, IPP isomerase; EC 5.3.3.2) can catalyze the isomerization of isopentenyl diphosphate to dimethylallyl diphosphate by an antarafacial transposition of hydrogen. In some embodiments of the cells, organisms, compositions and methods provided herein, the amount and/or activity of an isopentenyl diphosphate delta isomerase in a cell is modified. For example, in some aspects, a cell or microorganism may be modified to increase the amount and/or activity of an isopentenyl diphosphate delta isomerase, may be modified to decrease the amount and/or activity of an isopentenyl diphosphate delta isomerase, or may be modified to alternately increase and decrease the amount and/or activity of an isopentenyl diphosphate delta isomerase depending, for example, on the cellular location(s) of the enzyme and/or on the conditions in which the modified cell or microorganism is cultured.

In certain aspects, the amount and/or activity of an isopentenyl diphosphate delta isomerase in a cell is increased. Increasing the amount and/or activity of an isopentenyl diphosphate delta isomerase may be particularly beneficial in embodiments in which the flux of carbons from fatty acids is directed toward a particular target product pathway (e.g., geranyl diphosphate production, farnesyl diphosphate production, geranylgeranyl diphosphate production, terpene production, carotenoid production, beta carotene production, lycopene production, astaxanthin production) and away from other cellular metabolic pathways not involved in target molecule production.

In certain embodiments, isopentenyl diphosphate delta isomerase activity is unchanged in a host or engineered cell or organism. In some embodiments, the amount and/or activity of a host isopentenyl diphosphate delta isomerase can be increased by increasing the number of copies of a nucleic acid encoding an isopentenyl diphosphate delta isomerase (e.g., 1, 2, 3, 4, 5, 6, 7, 8, 9, 10, 15, 20, 25 or more copies of the nucleic acid); by increasing the activity of a promoter that regulates transcription of a nucleic acid encoding an isopentenyl diphosphate delta isomerase; or by increasing the number of copies of a nucleic acid encoding an isopentenyl diphosphate delta isomerase and increasing the activity of a promoter that regulates transcription of a nucleic acid encoding an isopentenyl diphosphate delta isomerase. In some embodiments, an isopentenyl diphosphate delta isomerase is endogenous to the host cell or microorganism. In one aspect of the cell or microbial systems and methods provided herein, the amount of isopentenyl diphosphate delta isomerase protein expressed in a cell can be increased by introducing heterologous nucleic acid encoding an isopentenyl diphosphate delta isomerase into a cell or microorganism. For example, introduction of heterologous nucleic acid encoding an isopentenyl diphosphate delta isomerase can result in increased copy number of such nucleic acids and/or provide for modification of the cellular location in which the protein is expressed.

In some embodiments, an isopentenyl diphosphate delta isomerase enzyme can be a fungal or bacterial protein. In a particular embodiment, the isopentenyl diphosphate delta isomerase enzyme can be a *Candida* (e.g., *C. tropicalis*, *C. viswanathii*, *C. maltosa*, *C. cloacae*), *Yarrowia* (e.g., *Y. lipolytica*), *Fusarium* (e.g., *F. oxysporum*), *Bacillus* (e.g., *B. megaterium*, *B. subtilis*), Chronobacter (e.g., *C. sakazakii*), *Xanthophyllomyces* (e.g., *X. dendrorhous*), or *Pantoea* (e.g., *P. ananatis*) protein. An example of a *Candida viswanathii* nucleotide sequence (SEQ ID NO: 377) encoding a polypeptide (ID/1; SEQ ID NO: 343) having an isopentenyl diphosphate delta isomerase activity is provided herein. An additional nonlimiting example of a nucleotide sequence encoding a polypeptide having isopentenyl diphosphate delta isomerase activity is a *Candida tropicalis* MYA-3404 isopentenyl-diphosphate delta-isomerase (NCBI Reference Sequence: XM_002545339.1).

Presence, absence or amount of isopentenyl diphosphate delta isomerase activity can be detected by any suitable method known in the art. For example, detection can be performed by using an isopentenyl diphosphate delta isomerase activity assay (see e.g., Diaz et al. (2012) Insect Biochem. Mol. Bio. 42(10):751-757). Nucleic acid sequences encoding native and/or modified isopentenyl diphosphate delta isomerase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding an isopentenyl diphosphate delta isomerase can be modified. For example, the amount of an isopentenyl diphosphate delta isomerase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of isopentenyl diphosphate delta isomerase expression by a carbon source or feedstock include RT-PCR or qRT-PCR after the host cell or microorganism has been exposed to the chosen carbon source or feedstock for varying amounts of time.

Decreasing isopentenyl diphosphate delta isomerase activity in a cell can be accomplished by modifying the amount of isopentenyl diphosphate delta isomerase protein expression in the cell, for example, by replacing the wild-type promoter of an endogenous isopentenyl diphosphate delta isomerase gene in a cell or organism with a weaker heterologous promoter, deleting or disrupting an endogenous gene, and/or replacing or modifying a gene encoding a wild-type isopentenyl diphosphate delta isomerase such that the encoded modified or substituted isopentenyl diphosphate delta isomerase protein has a reduced enzyme activity.

Modification of a Terpene Synthase Activity

Provided herein are one or more modifications to one or more terpene synthase activities. Terpene synthases may include one or more enzymes in a family of enzymes involved in terpene biosynthesis, such as, for example, terpene synthases known in the art and described in Yamada et al. (2015) PNAS 112(3):857-862. In some embodiments of the cells, organisms, compositions and methods provided herein, the amount and/or activity of a terpene synthase in a cell is modified. For example, in some aspects, a cell or microorganism may be modified to increase the amount and/or activity of a terpene synthase, may be modified to decrease the amount and/or activity of a terpene synthase, or may be modified to alternately increase and decrease the amount and/or activity of a terpene synthase depending, for example, on the cellular location(s) of the enzyme and/or on the conditions in which the modified cell or microorganism is cultured.

In certain aspects, the amount and/or activity of a terpene synthase in a cell is increased. Increasing the amount and/or activity of a terpene synthase may be particularly beneficial in embodiments in which the flux of carbons from fatty acids is directed toward a particular target product pathway (e.g., mevalonate production, isopentenyl diphosphate production, geranyl diphosphate production, farnesyl diphosphate production, geranylgeranyl diphosphate production, terpene production, carotenoid production, beta carotene production, lycopene production, astaxanthin production) and away from other cellular metabolic pathways not involved in target molecule production.

In certain embodiments, terpene synthase activity is unchanged in a host or engineered cell or organism. In some embodiments, the amount and/or activity of a host terpene synthase can be increased by increasing the number of copies of a nucleic acid encoding a terpene synthase (e.g., 1, 2, 3, 4, 5, 6, 7, 8, 9, 10, 15, 20, 25 or more copies of the nucleic acid); by increasing the activity of a promoter that regulates transcription of a nucleic acid encoding a terpene synthase; or by increasing the number of copies of a nucleic acid a terpene synthase and increasing the activity of a promoter that regulates transcription of a nucleic acid encoding a terpene synthase. In some embodiments, a terpene synthase is endogenous to the host cell or microorganism. In one aspect of the cell or microbial systems and methods provided herein, the amount of terpene synthase protein expressed in a cell can be increased by introducing heterologous nucleic acid encoding a terpene synthase into a cell or microorganism. For example, introduction of heterologous nucleic acid encoding a terpene synthase can result in increased copy number of such nucleic acids and/or provide for modification of the cellular location in which the protein is expressed. In some embodiments, a terpene synthase is not endogenous to the host cell or microorganism. In one aspect of the cell or microbial systems and methods provided herein, a terpene synthase protein can be expressed in a cell by introducing heterologous nucleic acid encoding a terpene synthase into a cell or microorganism.

In some embodiments, a terpene synthase enzyme can be a fungal or bacterial protein. In a particular embodiment, the terpene synthase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), or *Pantoea* (e.g., *P. ananatis*) protein.

Presence, absence or amount of terpene synthase activity can be detected by any suitable method known in the art. For example, detection can be performed by using an appropriate terpene synthase activity assay. Nucleic acid sequences encoding native and/or modified terpene synthase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a terpene synthase can be modified. For example, the amount of a terpene synthase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE)

gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of terpene synthase expression by a carbon source or feedstock include RT-PCR or qRT-PCR after the host cell or microorganism has been exposed to the chosen carbon source or feedstock for varying amounts of time.

Decreasing terpene synthase activity in a cell can be accomplished by modifying the amount of terpene synthase protein expression in the cell, for example, by replacing the wild-type promoter of an endogenous terpene synthase gene in a cell or organism with a weaker heterologous promoter, deleting or disrupting an endogenous gene, and/or replacing or modifying a gene encoding a wild-type terpene synthase such that the encoded modified or substituted terpene synthase protein has a reduced enzyme activity.

Modification of a Dimethylallyltranstransferase Activity

One component of terpene biosynthesis is the conversion of dimethylallyl diphosphate (dimethylallyl pyrophosphate) and isopentenyl diphosphate (isopentenyl pyrophosphate) into farnesyl diphosphate (farnesyl pyrophosphate). A dimethylallyltranstransferase enzyme (EC 2.5.1.1) can convert dimethylallyl diphosphate and isopentenyl diphosphate into farnesyl diphosphate. Dimethylallyltranstransferase may also be referred to as ERG20, farnesyl pyrophosphate synthase, farnesyl diphosphate synthase, or farnesyl diphosphate synthetase (EC 2.5.1.10). Geranyl diphosphate (geranyl pyrophosphate) often is created in an intermediate step. In some embodiments of the cells, organisms, compositions and methods provided herein, the amount and/or activity of a dimethylallyltranstransferase in a cell is modified. For example, in some aspects, a cell or microorganism may be modified to increase the amount and/or activity of a dimethylallyltranstransferase, may be modified to decrease the amount and/or activity of a dimethylallyltranstransferase, or may be modified to alternately increase and decrease the amount and/or activity of a dimethylallyltranstransferase depending, for example, on the cellular location(s) of the enzyme and/or on the conditions in which the modified cell or microorganism is cultured.

In certain aspects, the amount and/or activity of a dimethylallyltranstransferase in a cell is increased. Increasing the amount and/or activity of a dimethylallyltranstransferase may be particularly beneficial in embodiments in which the flux of carbons from fatty acids is directed toward a particular target product pathway (e.g., geranyl diphosphate production, farnesyl diphosphate production, geranylgeranyl diphosphate production, terpene production, carotenoid production, beta carotene production, lycopene production, astaxanthin production) and away from other cellular metabolic pathways not involved in target molecule production.

In certain embodiments, dimethylallyltranstransferase activity is unchanged in a host or engineered cell or organism. In some embodiments, the amount and/or activity of a host dimethylallyltranstransferase can be increased by increasing the number of copies of a nucleic acid encoding a dimethylallyltranstransferase (e.g., 1, 2, 3, 4, 5, 6, 7, 8, 9, 10, 15, 20, 25 or more copies of the nucleic acid); by increasing the activity of a promoter that regulates transcription of a nucleic acid encoding a dimethylallyltranstransferase; or by increasing the number of copies of a nucleic acid encoding a dimethylallyltranstransferase and increasing the activity of a promoter that regulates transcription of a nucleic acid encoding a dimethylallyltranstransferase. In some embodiments, a dimethylallyltranstransferase is endogenous to the host cell or microorganism. In one aspect of the cell or microbial systems and methods provided herein, the amount of dimethylallyltranstransferase protein expressed in a cell can be increased by introducing heterologous nucleic acid encoding a dimethylallyltranstransferase into a cell or microorganism. For example, introduction of heterologous nucleic acid encoding a dimethylallyltranstransferase can result in increased copy number of such nucleic acids and/or provide for modification of the cellular location in which the protein is expressed. In some embodiments, a dimethylallyltranstransferase is not endogenous to the host cell or microorganism. In one aspect of the cell or microbial systems and methods provided herein, a dimethylallyltranstransferase protein can be expressed in a cell by introducing heterologous nucleic acid encoding a dimethylallyltranstransferase into a cell or microorganism.

In some embodiments, a dimethylallyltranstransferase enzyme can be a fungal or bacterial protein. In a particular embodiment, the dimethylallyltranstransferase enzyme can be a *Candida* (e.g., *C. tropicalis*, *C. viswanathii*, *C. maltosa*, *C. cloacae*), *Yarrowia* (e.g., *Y. lipolytica*), *Fusarium* (e.g., *F. oxysporum*), *Bacillus* (e.g., *B. megaterium*, *B. subtilis*), Chronobacter (e.g., *C. sakazakii*), *Xanthophyllomyces* (e.g., *X. dendrorhous*), or *Pantoea* (e.g., *P. ananatis*) protein. An example of a *Candida viswanathii* nucleotide sequence (SEQ ID NO: 378) encoding a polypeptide (ERG20; SEQ ID NO: 344) having a dimethylallyltranstransferase activity is provided herein. An additional nonlimiting example of a nucleotide sequence encoding a polypeptide having dimethylallyltranstransferase activity is *Candida tropicalis* MYA-3404 farnesyl pyrophosphate synthetase (NCBI Reference Sequence: XM_002547254.1).

Presence, absence or amount of dimethylallyltranstransferase activity can be detected by any suitable method known in the art. For example, detection can be performed by using a dimethylallyltranstransferase ELISA kit (e.g., MYBIOSOURCE, MBS943684). Nucleic acid sequences encoding native and/or modified dimethylallyltranstransferase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a dimethylallyltranstransferase can be modified. For example, the amount of a dimethylallyltranstransferase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of dimethylallyltranstransferase expression by a carbon source or feedstock include RT-PCR or qRT-PCR after the host cell or microorganism has been exposed to the chosen carbon source or feedstock for varying amounts of time.

Decreasing dimethylallyltranstransferase activity in a cell can be accomplished by modifying the amount of dimethylallyltranstransferase protein expression in the cell, for example, by replacing the wild-type promoter of an endogenous dimethylallyltranstransferase gene in a cell or organism with a weaker heterologous promoter, deleting or disrupting an endogenous gene, and/or replacing or modifying a gene encoding a wild-type dimethylallyltranstransferase such that the encoded modified or substituted dimethylallyltranstransferase protein has a reduced enzyme activity.

Modification of a Geranylgeranyl Diphosphate Synthase Activity

Another component of terpene biosynthesis is the synthesis of geranylgeranyl diphosphate from farnesyl diphosphate and isopentenyl diphosphate. A geranylgeranyl diphosphate synthase enzyme (also referred to as BTS1, CrtE, GGPS1, GGPPS, GGPPS1, geranylgeranyl diphosphate synthase 1; EC 2.5.1.29) can catalyze the synthesis of geranylgeranyl diphosphate from farnesyl diphosphate and isopentenyl diphosphate. In some embodiments of the cells, organisms, compositions and methods provided herein, the amount and/or activity of a geranylgeranyl diphosphate synthase in a cell is modified. For example, in some aspects, a cell or microorganism may be modified to increase the amount and/or activity of a geranylgeranyl diphosphate synthase, may be modified to decrease the amount and/or activity of geranylgeranyl diphosphate synthase, or may be modified to alternately increase and decrease the amount and/or activity of an geranylgeranyl diphosphate synthase depending, for example, on the cellular location(s) of the enzyme and/or on the conditions in which the modified cell or microorganism is cultured.

In certain aspects, the amount and/or activity of a geranylgeranyl diphosphate synthase in a cell is increased. Increasing the amount and/or activity of a geranylgeranyl diphosphate synthase may be particularly beneficial in embodiments in which the flux of carbons from fatty acids is directed toward a particular target product pathway (e.g., mevalonate production, isopentenyl diphosphate production, geranyl diphosphate production, farnesyl diphosphate production, geranylgeranyl diphosphate production, terpene production, carotenoid production, beta carotene production, lycopene production, astaxanthin production) and away from other cellular metabolic pathways not involved in target molecule production.

In certain embodiments, geranylgeranyl diphosphate synthase activity is unchanged in a host or engineered cell or organism. In some embodiments, the amount and/or activity of a host geranylgeranyl diphosphate synthase can be increased by increasing the number of copies of a nucleic acid encoding a geranylgeranyl diphosphate synthase (e.g., 1, 2, 3, 4, 5, 6, 7, 8, 9, 10, 15, 20, 25 or more copies of the nucleic acid); by increasing the activity of a promoter that regulates transcription of a nucleic acid encoding a geranylgeranyl diphosphate synthase; or by increasing the number of copies of a nucleic acid encoding a geranylgeranyl diphosphate synthase and increasing the activity of a promoter that regulates transcription of a nucleic acid encoding a geranylgeranyl diphosphate synthase. In some embodiments, a geranylgeranyl diphosphate synthase is endogenous to the host cell or microorganism. In one aspect of the cell or microbial systems and methods provided herein, the amount of geranylgeranyl diphosphate synthase protein expressed in a cell can be increased by introducing heterologous nucleic acid encoding a geranylgeranyl diphosphate synthase into a cell or microorganism. For example, introduction of heterologous nucleic acid encoding a geranylgeranyl diphosphate synthase can result in increased copy number of such nucleic acids and/or provide for modification of the cellular location in which the protein is expressed. In some embodiments, a geranylgeranyl diphosphate synthase is not endogenous to the host cell or microorganism. In one aspect of the cell or microbial systems and methods provided herein, a geranylgeranyl diphosphate synthase protein can be expressed in a cell by introducing heterologous nucleic acid encoding a geranylgeranyl diphosphate synthase into a cell or microorganism.

In some embodiments, a geranylgeranyl diphosphate synthase enzyme can be a fungal or bacterial protein. In a particular embodiment, the geranylgeranyl diphosphate synthase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), or *Pantoea* (e.g., *P. ananatis*) protein. An example of a *Candida viswanathii* nucleotide sequence (SEQ ID NO: 379) encoding a polypeptide (BTS1; SEQ ID NO: 345) having a geranylgeranyl diphosphate synthase activity is provided herein. Additional nonlimiting examples of nucleotide sequences encoding polypeptides having geranylgeranyl diphosphate synthase activity are provided herein which include: *Chronobacter sakazakii* CrtE gene (SEQ ID NO:357), which encodes CsCrtE (SEQ ID NO:326); *Xanthophyllomyces* dendrorhous CrtE gene (SEQ ID NO: 360, which encodes XdCrtE (SEQ ID NO:329); and *Pantoea ananatis* CrtE gene (SEQ ID NO: 363), which encodes PaCrtE (SEQ ID NO:332).

Presence, absence or amount of geranylgeranyl diphosphate synthase activity can be detected by any suitable method known in the art. For example, detection can be performed by using a geranylgeranyl diphosphate synthase ELISA kit (e.g., MYBIOSOURCE, MBS929545). Nucleic acid sequences encoding native and/or modified geranylgeranyl diphosphate synthase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a geranylgeranyl diphosphate synthase can be modified. For example, the amount of a geranylgeranyl diphosphate synthase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of geranylgeranyl diphosphate synthase expression by a carbon source or feedstock include RT-PCR or qRT-PCR after the host cell or microorganism has been exposed to the chosen carbon source or feedstock for varying amounts of time.

Decreasing geranylgeranyl diphosphate synthase activity in a cell can be accomplished by modifying the amount of geranylgeranyl diphosphate synthase protein expression in the cell, for example, by replacing the wild-type promoter of an endogenous geranylgeranyl diphosphate synthase gene in a cell or organism with a weaker heterologous promoter, deleting or disrupting an endogenous gene, and/or replacing or modifying a gene encoding a wild-type geranylgeranyl diphosphate synthase such that the encoded modified or substituted geranylgeranyl diphosphate synthase protein has a reduced enzyme activity.

Modification of a Phytoene Synthase Activity

Another component of terpene biosynthesis is the conversion of geranylgeranyl diphosphate (geranylgeranyl pyrophosphate) to phytoene. A phytoene synthase enzyme (also referred to as CrtB, prephytoene-diphosphate synthase, 15-cis-phytoene synthase, PSase, geranylgeranyl-diphosphate geranylgeranyltransferase; EC 2.5.1.32) is a transferase enzyme that can catalyze the conversion of geranylgeranyl diphosphate to phytoene. In some embodiments of the cells, organisms, compositions and methods provided herein, the amount and/or activity of a phytoene synthase in a cell is modified. For example, in some aspects, a cell or microorganism may be modified to increase the amount and/or activity of a phytoene synthase, may be modified to decrease the amount and/or activity of a phytoene synthase, or may be modified to alternately increase and decrease the amount and/or activity of a phytoene synthase depending, for example, on the cellular location(s) of the enzyme and/or on the conditions in which the modified cell or microorganism is cultured.

In certain aspects, the amount and/or activity of a phytoene synthase in a cell is increased. Increasing the amount and/or activity of a phytoene synthase may be particularly beneficial in embodiments in which the flux of carbons from fatty acids is directed toward a particular target product pathway (e.g., terpene production, carotenoid production, beta carotene production, lycopene production, astaxanthin production) and away from other cellular metabolic pathways not involved in target molecule production.

In certain embodiments, phytoene synthase activity is unchanged in a host or engineered cell or organism. In some embodiments, the amount and/or activity of a host phytoene synthase can be increased by increasing the number of copies of a nucleic acid encoding a phytoene synthase (e.g., 1, 2, 3, 4, 5, 6, 7, 8, 9, 10, 15, 20, 25 or more copies of the nucleic acid); by increasing the activity of a promoter that regulates transcription of a nucleic acid encoding a phytoene synthase; or by increasing the number of copies of a nucleic acid encoding a phytoene synthase and increasing the activity of a promoter that regulates transcription of a nucleic acid encoding a phytoene synthase. In some embodiments, a phytoene synthase is endogenous to the host cell or microorganism. In one aspect of the cell or microbial systems and methods provided herein, the amount of phytoene synthase protein expressed in a cell can be increased by introducing heterologous nucleic acid encoding a phytoene synthase into a cell or microorganism. For example, introduction of heterologous nucleic acid encoding a phytoene synthase can result in increased copy number of such nucleic acids and/or provide for modification of the cellular location in which the protein is expressed. In some embodiments, a phytoene synthase is not endogenous to the host cell or microorganism. In one aspect of the cell or microbial systems and methods provided herein, a phytoene synthase protein can be expressed in a cell by introducing heterologous nucleic acid encoding a phytoene synthase into a cell or microorganism.

In some embodiments, a phytoene synthase enzyme can be a fungal or bacterial protein. In a particular embodiment, the phytoene synthase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), or *Pantoea* (e.g., *P. ananatis*) protein. An example of a *Chronobacter sakazakii* nucleotide sequence (SEQ ID NO: 359) encoding a polypeptide (CsCrtB; SEQ ID NO: 328) having a phytoene synthase activity is provided herein. An example of a *Pantoea ananatis* nucleotide sequence (SEQ ID NO: 365) encoding a polypeptide (PaCrtB; SEQ ID NO: 334) having a phytoene synthase activity is provided herein.

Presence, absence or amount of phytoene synthase activity can be detected by any suitable method known in the art. For example, detection can be performed by using phytoene synthase activity assay (see e.g., Lopez-Emparan et al. (2014) PLoS One 9(12):e114878; Schledz et al. (1996) The Plant Journal 10(5):781-792). Nucleic acid sequences encoding native and/or modified phytoene synthase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a phytoene synthase can be modified. For example, the amount of a phytoene synthase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of phytoene synthase expression by a carbon source or feedstock include RT-PCR or qRT-PCR after the host cell or microorganism has been exposed to the chosen carbon source or feedstock for varying amounts of time.

Decreasing phytoene synthase activity in a cell can be accomplished by modifying the amount of phytoene synthase protein expression in the cell, for example, by replacing the wild-type promoter of an endogenous phytoene synthase gene in a cell or organism with a weaker heterologous promoter, deleting or disrupting an endogenous gene, and/or replacing or modifying a gene encoding a wild-type phytoene synthase such that the encoded modified or substituted phytoene synthase protein has a reduced enzyme activity.

Modification of a Phytoene Desaturase Activity

Another component of terpene biosynthesis is the conversion of phytoene to lycopene. A phytoene desaturase enzyme can catalyze the conversion of phytoene to lycopene. In some embodiments, a phytoene desaturase is a 3,4-didehydrolycopene-forming phytoene desaturase (also referred to as 5-step phytoene desaturase, five-step phytoene desaturase, Al-1, 15-cis-phytoene:acceptor oxidoreductase (3,4-didehydrolycopene-forming); EC 1.3.99.30). In some embodiments, a phytoene desaturase is a neurosporene-forming phytoene desaturase (also referred to as CrtI, 3-step phytoene desaturase, three-step phytoene desaturase, 15-cis-phytoene:acceptor oxidoreductase (neurosporene-forming); EC 1.3.99.28). In some embodiments of the cells, organisms, compositions and methods provided herein, the amount and/or activity of a phytoene desaturase in a cell is modified. For example, in some aspects, a cell or microorganism may be modified to increase the amount and/or activity of a phytoene desaturase, may be modified to decrease the amount and/or activity of a phytoene desaturase, or may be modified to alternately increase and decrease the amount and/or activity of a phytoene desaturase depending, for example, on the cellular location(s) of the enzyme and/or on the conditions in which the modified cell or microorganism is cultured.

In certain aspects, the amount and/or activity of a phytoene desaturase in a cell is increased. Increasing the amount and/or activity of a phytoene desaturase may be particularly beneficial in embodiments in which the flux of carbons from fatty acids is directed toward a particular target product pathway (e.g., terpene production, carotenoid production, beta carotene production, lycopene production, astaxanthin production) and away from other cellular metabolic pathways not involved in target molecule production.

In certain embodiments, phytoene desaturase activity is unchanged in a host or engineered cell or organism. In some embodiments, the amount and/or activity of a host phytoene desaturase can be increased by increasing the number of copies of a nucleic acid encoding a phytoene desaturase (e.g., 1, 2, 3, 4, 5, 6, 7, 8, 9, 10, 15, 20, 25 or more copies of the nucleic acid); by increasing the activity of a promoter that regulates transcription of a nucleic acid encoding a phytoene desaturase; or by increasing the number of copies of a nucleic acid encoding a phytoene desaturase and increasing the activity of a promoter that regulates transcription of a nucleic acid encoding a phytoene desaturase. In some embodiments, a phytoene desaturase is endogenous to the host cell or microorganism. In one aspect of the cell or microbial systems and methods provided herein, the amount of phytoene desaturase protein expressed in a cell can be increased by introducing heterologous nucleic acid encoding a phytoene desaturase into a cell or microorganism. For example, introduction of heterologous nucleic acid encoding a phytoene desaturase can result in increased copy number of such nucleic acids and/or provide for modification of the cellular location in which the protein is expressed. In some embodiments, a phytoene desaturase is not endogenous to the host cell or microorganism. In one aspect of the cell or microbial systems and methods provided herein, a phytoene desaturase protein can be expressed in a cell by introducing heterologous nucleic acid encoding a phytoene desaturase into a cell or microorganism.

In some embodiments, a phytoene desaturase enzyme can be a fungal or bacterial protein. In a particular embodiment, the phytoene desaturase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), or *Pantoea* (e.g., *P. ananatis*) protein. An example of a *Chronobacter sakazakii* nucleotide sequence (SEQ ID NO: 358) encoding a polypeptide (CsCrtI; SEQ ID NO: 327) having a phytoene desaturase activity is provided herein. An example of a *Xanthophyllomyces* dendrorhous nucleotide sequence (SEQ ID NO: 361) encoding a polypeptide (XdCrtI; SEQ ID NO: 330) having a phytoene desaturase activity is provided herein. An example of a *Pantoea ananatis* nucleotide sequence (SEQ ID NO: 364) encoding a polypeptide (PaCrtI; SEQ ID NO: 333) having a phytoene desaturase activity is provided herein.

Presence, absence or amount of phytoene desaturase activity can be detected by any suitable method known in the art. For example, detection can be performed by using a phytoene desaturase activity assay (see e.g., Xu et al. (2007) Microbiology 153:1642-52). Nucleic acid sequences encoding native and/or modified phytoene desaturase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a phytoene desaturase can be modified. For example, the amount of a phytoene desaturase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of phytoene desaturase expression by a carbon source or feedstock include RT-PCR or qRT-PCR after the host cell or microorganism has been exposed to the chosen carbon source or feedstock for varying amounts of time.

Decreasing phytoene desaturase activity in a cell can be accomplished by modifying the amount of phytoene desaturase protein expression in the cell, for example, by replacing the wild-type promoter of an endogenous phytoene desaturase gene in a cell or organism with a weaker heterologous promoter, deleting or disrupting an endogenous gene, and/or replacing or modifying a gene encoding a wild-type phytoene desaturase such that the encoded modified or substituted phytoene desaturase protein has a reduced enzyme activity.

Modification of a Lycopene Cyclase Activity and/or Modification of a Bifunctional Lycopene Cyclase/Phytoene Synthase Activity Another component of terpene biosynthesis is the conversion of lycopene to beta carotene. A lycopene cyclase enzyme (also referred to as lycopene beta-cyclase, CrtY, CrtL (beta-ionone end group producing), CrtL (eta-ionone end group producing) and CrtL (capsanthin/capsorubin synthase); EC 5.5.1.19) can catalyze the conversion of lycopene to beta carotene. The cyclization of lycopene is typically the final step in carotenoid biosynthesis and may proceed via one of two pathways: the formation of a beta ring by beta-cyclase, or an epsilon ring by epsilon-cyclase. Epsilon-cyclase adds one ring, forming a monocyclic delta-carotene, and beta-cyclase introduces a ring at both ends of lycopene to form a bicyclic beta-carotene. In some embodiments, a lycopene cyclase is a bifunctional lycopene cyclase/phytoene synthase (also referred to as CrtYB), which includes a lycopene beta-cyclase domain (EC 5.5.1.19) and a phytoene synthase domain (EC 2.5.1.32). A bifunctional lycopene cyclase can catalyze the reaction from geranylgeranyl diphosphate to phytoene (phytoene synthase) and the reaction from lycopene to beta-carotene via an intermediate gamma-carotene (lycopene cyclase). A bifunctional enzyme containing lycopene cyclase activity and phytoene synthase activity may be referred to herein as a bifunctional lycopene cyclase/phytoene synthase or a bifunctional lycopene cyclase.

In some embodiments of the cells, organisms, compositions and methods provided herein, the amount and/or activity of a lycopene cyclase in a cell is modified. For example, in some aspects, a cell or microorganism may be modified to increase the amount and/or activity of a lycopene cyclase, may be modified to decrease the amount and/or activity of a lycopene cyclase, or may be modified to alternately increase and decrease the amount and/or activity of a lycopene cyclase depending, for example, on the cellular location(s) of the enzyme and/or on the conditions in which the modified cell or microorganism is cultured.

In some embodiments of the cells, organisms, compositions and methods provided herein, the amount and/or activity of a bifunctional lycopene cyclase/phytoene synthase in a cell is modified. For example, in some aspects, a cell or microorganism may be modified to increase the amount and/or activity of a bifunctional lycopene cyclase/phytoene synthase, may be modified to decrease the amount and/or activity of a bifunctional lycopene cyclase/phytoene synthase, or may be modified to alternately increase and decrease the amount and/or activity of a bifunctional lycopene cyclase/phytoene synthase depending, for example, on the cellular location(s) of the enzyme and/or on the conditions in which the modified cell or microorganism is cultured.

In certain aspects, the amount and/or activity of a lycopene cyclase in a cell is increased. Increasing the amount and/or activity of a lycopene cyclase may be particularly beneficial in embodiments in which the flux of carbons from fatty acids is directed toward a particular target product pathway (e.g., terpene production, carotenoid production, beta carotene production, astaxanthin production) and away from other cellular metabolic pathways not involved in target molecule production.

In certain aspects, the amount and/or activity of a bifunctional lycopene cyclase/phytoene synthase in a cell is increased. Increasing the amount and/or activity of a bifunctional lycopene cyclase/phytoene synthase may be particularly beneficial in embodiments in which the flux of carbons from fatty acids is directed toward a particular target product pathway (e.g., terpene production, carotenoid production, beta carotene production, astaxanthin production) and away from other cellular metabolic pathways not involved in target molecule production.

In certain embodiments, lycopene cyclase activity is unchanged in a host or engineered cell or organism. In some embodiments, the amount and/or activity of a host lycopene cyclase can be increased by increasing the number of copies of a nucleic acid encoding a lycopene cyclase (e.g., 1, 2, 3, 4, 5, 6, 7, 8, 9, 10, 15, 20, 25 or more copies of the nucleic acid); by increasing the activity of a promoter that regulates transcription of a nucleic acid encoding a lycopene cyclase; or by increasing the number of copies of a nucleic acid encoding a lycopene cyclase and increasing the activity of a promoter that regulates transcription of a nucleic acid encoding a lycopene cyclase. In some embodiments, a lycopene cyclase is endogenous to the host cell or microorganism. In one aspect of the cell or microbial systems and methods provided herein, the amount of lycopene cyclase protein expressed in a cell can be increased by introducing heterologous nucleic acid encoding a lycopene cyclase into a cell or microorganism. For example, introduction of heterologous nucleic acid encoding a lycopene cyclase can result in increased copy number of such nucleic acids and/or provide for modification of the cellular location in which the protein is expressed. In some embodiments, a lycopene cyclase is not endogenous to the host cell or microorganism. In one aspect of the cell or microbial systems and methods provided herein, a lycopene cyclase protein can be expressed in a cell by introducing heterologous nucleic acid encoding a lycopene cyclase into a cell or microorganism.

In certain embodiments, bifunctional lycopene cyclase/phytoene synthase activity is unchanged in a host or engineered cell or organism. In some embodiments, the amount and/or activity of a host bifunctional lycopene cyclase/phytoene synthase can be increased by increasing the number of copies of a nucleic acid encoding a bifunctional lycopene cyclase/phytoene synthase (e.g., 1, 2, 3, 4, 5, 6, 7, 8, 9, 10, 15, 20, 25 or more copies of the nucleic acid); by increasing the activity of a promoter that regulates transcription of a nucleic acid encoding a bifunctional lycopene cyclase/phytoene synthase; or by increasing the number of copies of a nucleic acid encoding a bifunctional lycopene cyclase/phytoene synthase and increasing the activity of a promoter that regulates transcription of a nucleic acid encoding a bifunctional lycopene cyclase/phytoene synthase. In some embodiments, a bifunctional lycopene cyclase/phytoene synthase is endogenous to the host cell or microorganism. In one aspect of the cell or microbial systems and methods provided herein, the amount of bifunctional lycopene cyclase/phytoene synthase protein expressed in a cell can be increased by introducing heterologous nucleic acid encoding a bifunctional lycopene cyclase/phytoene synthase into a cell or microorganism. For example, introduction of heterologous nucleic acid encoding a bifunctional lycopene cyclase/phytoene synthase can result in increased copy number of such nucleic acids and/or provide for modification of the cellular location in which the protein is expressed. In some embodiments, a bifunctional lycopene cyclase/phytoene synthase is not endogenous to the host cell or microorganism. In one aspect of the cell or microbial systems and methods provided herein, a bifunctional lycopene cyclase/phytoene synthase protein can be expressed in a cell by introducing heterologous nucleic acid encoding a bifunctional lycopene cyclase/phytoene synthase into a cell or microorganism.

In some embodiments, a lycopene cyclase enzyme and/or a bifunctional lycopene cyclase/phytoene synthase enzyme can be a fungal or bacterial protein. In a particular embodiment, the lycopene cyclase enzyme and/or the bifunctional lycopene cyclase/phytoene synthase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), or *Pantoea* (e.g., *P. ananatis*) protein. An example of a *Xanthophyllomyces* dendrorhous nucleotide sequence (SEQ ID NO: 362) encoding a polypeptide (XdCrtYB; SEQ ID NO: 331) having a bifunctional lycopene cyclase/phytoene synthase activity is provided herein.

Presence, absence or amount of lycopene cyclase activity and/or bifunctional lycopene cyclase/phytoene synthase activity can be detected by any suitable method known in the art. For example, detection can be performed by using a lycopene cyclase activity assay (see e.g., Yu et al. (2010) J. Biol. Chem. 285(16):12109-12120). Nucleic acid sequences encoding native and/or modified lycopene cyclase sequences and/or bifunctional lycopene cyclase/phytoene synthase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a lycopene cyclase and/or a bifunctional lycopene cyclase/phytoene synthase can be modified. For example, the amount of a lycopene cyclase protein and/or a bifunctional lycopene cyclase/phytoene synthase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of lycopene cyclase expression and/or a bifunctional lycopene cyclase/phytoene synthase expression by a carbon source or feedstock include RT-PCR or qRT-PCR after the host cell or microorganism has been exposed to the chosen carbon source or feedstock for varying amounts of time.

Decreasing lycopene cyclase activity in a cell can be accomplished by modifying the amount of lycopene cyclase protein expression in the cell, for example, by replacing the wild-type promoter of an endogenous lycopene cyclase gene in a cell or organism with a weaker heterologous promoter, deleting or disrupting an endogenous gene, and/or replacing or modifying a gene encoding a wild-type lycopene cyclase such that the encoded modified or substituted lycopene cyclase protein has a reduced enzyme activity.

Decreasing bifunctional lycopene cyclase/phytoene synthase activity in a cell can be accomplished by modifying the amount of bifunctional lycopene cyclase/phytoene synthase protein expression in the cell, for example, by replacing the wild-type promoter of an endogenous bifunctional lycopene cyclase/phytoene synthase gene in a cell or organism with a weaker heterologous promoter, deleting or disrupting an endogenous gene, and/or replacing or modifying a gene encoding a wild-type bifunctional lycopene cyclase/phytoene synthase such that the encoded modified or substituted bifunctional lycopene cyclase/phytoene synthase protein has a reduced enzyme activity.

Modification of a Beta Carotene Ketolase Activity

Additional components of terpene biosynthesis include, for example, astaxanthin biosysnthesis (e.g., the conversion of beta carotene to astaxanthin), canthaxanthin biosynthesis, and zeaxanthin biosynthesis. Canthaxanthin, for example, may be produced using a beta carotene ketolase enzyme (also referred to as CrtW, beta carotene monoketolase, beta-carotene oxygenase; EC 1.3.5.B4). Astaxanthin, for example, may be produced using a beta carotene ketolase enzyme in conjunction with a beta carotene hydroxylase (discussed below). In some embodiments of the cells, organisms, compositions and methods provided herein, the amount and/or activity of a beta carotene ketolase in a cell is modified. For example, in some aspects, a cell or microorganism may be modified to increase the amount and/or activity of a beta carotene ketolase, may be modified to decrease the amount and/or activity of a beta carotene ketolase, or may be modified to alternately increase and decrease the amount and/or activity of a beta carotene ketolase depending, for example, on the cellular location(s) of the enzyme and/or on the conditions in which the modified cell or microorganism is cultured.

In certain aspects, the amount and/or activity of a beta carotene ketolase in a cell is increased. Increasing the amount and/or activity of a beta carotene ketolase may be particularly beneficial in embodiments in which the flux of carbons from fatty acids is directed toward a particular target product pathway (e.g., terpene production, carotenoid production, astaxanthin production) and away from other cellular metabolic pathways not involved in target molecule production.

In certain embodiments beta carotene ketolase activity is unchanged in a host or engineered cell or organism. In some embodiments, the amount and/or activity of a host beta carotene ketolase can be increased by increasing the number of copies of a nucleic acid encoding an beta carotene ketolase (e.g., 1, 2, 3, 4, 5, 6, 7, 8, 9, 10, 15, 20, 25 or more copies of the nucleic acid); by increasing the activity of a promoter that regulates transcription of a nucleic acid encoding a beta carotene ketolase; or by increasing the number of copies of a nucleic acid encoding a beta carotene ketolase and increasing the activity of a promoter that regulates transcription of a nucleic acid encoding a beta carotene ketolase. In some embodiments, a beta carotene ketolase is endogenous to the host cell or microorganism. In one aspect of the cell or microbial systems and methods provided herein, the amount of beta carotene ketolase protein expressed in a cell can be increased by introducing heterologous nucleic acid encoding a beta carotene ketolase into a cell or microorganism. For example, introduction of heterologous nucleic acid encoding a beta carotene ketolase can result in increased copy number of such nucleic acids and/or provide for modification of the cellular location in which the protein is expressed. In some embodiments, a beta carotene ketolase is not endogenous to the host cell or microorganism. In one aspect of the cell or microbial systems and methods provided herein, a beta carotene ketolase protein can be expressed in a cell by introducing heterologous nucleic acid encoding a beta carotene ketolase into a cell or microorganism.

In some embodiments, a beta carotene ketolase enzyme can be a fungal or bacterial protein. In a particular embodiment, the beta carotene ketolase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), *Pantoea* (e.g., *P. ananatis*), or *Agrobacterium* (e.g., *A. aurantiacum*) protein. An example of an *Agrobacterium aurantiacum* nucleotide sequence (SEQ ID NO: 369) encoding a polypeptide (AaCrtW, SEQ ID NO: 351) having a beta carotene ketolase activity is provided herein.

Presence, absence or amount of beta carotene ketolase activity can be detected by any suitable method known in the art. For example, detection can be performed by using an appropriate beta carotene ketolase activity assay. Nucleic acid sequences encoding native and/or modified beta carotene ketolase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a beta carotene ketolase can be modified. For example, the amount of a beta carotene ketolase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of beta carotene ketolase expression by a carbon source or feedstock include RT-PCR or qRT-PCR after the host cell or microorganism has been exposed to the chosen carbon source or feedstock for varying amounts of time.

Decreasing beta carotene ketolase activity in a cell can be accomplished by modifying the amount of beta carotene ketolase protein expression in the cell, for example, by replacing the wild-type promoter of an endogenous beta carotene ketolase gene in a cell or organism with a weaker heterologous promoter, deleting or disrupting an endogenous gene, and/or replacing or modifying a gene encoding a wild-type beta carotene ketolase such that the encoded modified or substituted beta carotene ketolase protein has a reduced enzyme activity.

Modification of a Beta Carotene Hydroxylase Activity

In certain instances, astaxanthin and/or zeaxanthin may be produced using a beta carotene hydroxylase enzyme (also referred to as CrtZ, beta-carotene 3-hydroxylase, beta-carotene 3,3'-monooxygenase, beta-carotene, NADH:oxygen 3-oxidoreductase; EC 1.14.13.129). In some embodiments of the cells, organisms, compositions and methods provided herein, the amount and/or activity of a beta carotene hydroxylase in a cell is modified. For example, in some aspects, a cell or microorganism may be modified to increase the amount and/or activity of a beta carotene hydroxylase, may be modified to decrease the amount and/or activity of a beta carotene hydroxylase, or may be modified to alternately increase and decrease the amount and/or activity of a beta carotene hydroxylase depending, for example, on the cellular location(s) of the enzyme and/or on the conditions in which the modified cell or microorganism is cultured.

In certain aspects, the amount and/or activity of a beta carotene hydroxylase in a cell is increased. Increasing the amount and/or activity of a beta carotene hydroxylase may be particularly beneficial in embodiments in which the flux of carbons from fatty acids is directed toward a particular target product pathway (e.g., terpene production, carotenoid production, astaxanthin production) and away from other cellular metabolic pathways not involved in target molecule production.

In certain embodiments, beta carotene hydroxylase activity is unchanged in a host or engineered cell or organism. In some embodiments, the amount and/or activity of a host beta carotene hydroxylase can be increased by increasing the number of copies of a nucleic acid encoding a beta carotene hydroxylase (e.g., 1, 2, 3, 4, 5, 6, 7, 8, 9, 10, 15, 20, 25 or more copies of the nucleic acid); by increasing the activity of a promoter that regulates transcription of a nucleic acid encoding a beta carotene hydroxylase; or by increasing the number of copies of a nucleic acid encoding a beta carotene hydroxylase and increasing the activity of a promoter that regulates transcription of a nucleic acid encoding a beta carotene hydroxylase. In some embodiments, a beta carotene hydroxylase is endogenous to the host cell or microorganism. In one aspect of the cell or microbial systems and methods provided herein, the amount of beta carotene hydroxylase protein expressed in a cell can be increased by introducing heterologous nucleic acid encoding a beta carotene hydroxylase into a cell or microorganism. For example, introduction of heterologous nucleic acid encoding a beta carotene hydroxylase can result in increased copy number of such nucleic acids and/or provide for modification of the cellular location in which the protein is expressed. In some embodiments, a beta carotene hydroxylase is not endogenous to the host cell or microorganism. In one aspect of the cell or microbial systems and methods provided herein, a beta carotene hydroxylase protein can be expressed in a cell by introducing heterologous nucleic acid encoding a beta carotene hydroxylase into a cell or microorganism.

In some embodiments, a beta carotene hydroxylase enzyme can be a fungal or bacterial protein. In a particular embodiment, the beta carotene hydroxylase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), *Pantoea* (e.g., *P. ananatis*) or *Agrobacterium* (e.g., *A. aurantiacum*) protein. An example of an *Agrobacterium aurantiacum* nucleotide sequence (SEQ ID NO: 368) encoding a polypeptide (AaCrtZ; SEQ ID NO: 350) having a beta carotene hydroxylase activity is provided herein.

Presence, absence or amount of beta carotene hydroxylase activity can be detected by any suitable method known in the art. For example, detection can be performed by using an appropriate beta carotene hydroxylase activity assay. Nucleic acid sequences encoding native and/or modified beta carotene hydroxylase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a beta carotene hydroxylase can be modified. For example, the amount of a beta carotene hydroxylase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of beta carotene hydroxylase expression by a carbon source or feedstock include RT-PCR or qRT-PCR after the host cell or microorganism has been exposed to the chosen carbon source or feedstock for varying amounts of time.

Decreasing beta carotene hydroxylase activity in a cell can be accomplished by modifying the amount of beta carotene hydroxylase protein expression in the cell, for example, by replacing the wild-type promoter of an endogenous beta carotene hydroxylase gene in a cell or organism with a weaker heterologous promoter, deleting or disrupting an endogenous gene, and/or replacing or modifying a gene encoding a wild-type beta carotene hydroxylase such that the encoded modified or substituted beta carotene hydroxylase protein has a reduced enzyme activity.

Modification of an Astaxanthin Synthase Activity

In certain instances, astaxanthin may be produced using an astaxanthin synthase enzyme (also referred to as CrtS, astaxanthin synthetase, cytochrome-450 hydroxylase, cytochrome-P450 hydroxylase/astaxanthin synthase). In some embodiments of the cells, organisms, compositions and methods provided herein, the amount and/or activity of an astaxanthin synthase in a cell is modified. For example, in some aspects, a cell or microorganism may be modified to increase the amount and/or activity of an astaxanthin synthase, may be modified to decrease the amount and/or activity of an astaxanthin synthase, or may be modified to alternately increase and decrease the amount and/or activity of an astaxanthin synthase depending, for example, on the cellular location(s) of the enzyme and/or on the conditions in which the modified cell or microorganism is cultured.

In certain aspects, the amount and/or activity of an astaxanthin synthase in a cell is increased. Increasing the amount and/or activity of an astaxanthin synthase may be particularly beneficial in embodiments in which the flux of carbons from fatty acids is directed toward a particular target product pathway (e.g., terpene production, carotenoid production, astaxanthin production) and away from other cellular metabolic pathways not involved in target molecule production.

In certain embodiments, astaxanthin synthase activity is unchanged in a host or engineered cell or organism. In some embodiments, the amount and/or activity of a host astaxanthin synthase can be increased by increasing the number of copies of a nucleic acid encoding an astaxanthin synthase (e.g., 1, 2, 3, 4, 5, 6, 7, 8, 9, 10, 15, 20, 25 or more copies of the nucleic acid); by increasing the activity of a promoter that regulates transcription of a nucleic acid encoding an astaxanthin synthase; or by increasing the number of copies of a nucleic acid encoding an astaxanthin synthase and increasing the activity of a promoter that regulates transcription of a nucleic acid encoding an astaxanthin synthase. In some embodiments, an astaxanthin synthase is endogenous to the host cell or microorganism. In one aspect of the cell or microbial systems and methods provided herein, the amount of astaxanthin synthase protein expressed in a cell can be increased by introducing heterologous nucleic acid encoding an astaxanthin synthase into a cell or microorganism. For example, introduction of heterologous nucleic acid encoding an astaxanthin synthase can result in increased copy number of such nucleic acids and/or provide for modification of the cellular location in which the protein is expressed. In some embodiments, a astaxanthin synthase is not endogenous to the host cell or microorganism. In one aspect of the cell or microbial systems and methods provided herein, a astaxanthin synthase protein can be expressed in a cell by introducing heterologous nucleic acid encoding a astaxanthin synthase into a cell or microorganism.

In some embodiments, an astaxanthin synthase enzyme can be a fungal or bacterial protein. In a particular embodiment, the astaxanthin synthase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), or *Pantoea* (e.g., *P. ananatis*) protein. An example of a *Xanthophyllomyces* dendrorhous nucleotide sequence (SEQ ID NO: 367) encoding a polypeptide (XdCrtS; SEQ ID NO: 336) having an astaxanthin synthase activity is provided herein.

Presence, absence or amount astaxanthin synthase activity can be detected by any suitable method known in the art. For example, detection can be performed by using an appropriate astaxanthin synthase activity assay. Nucleic acid sequences encoding native and/or modified astaxanthin synthase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding an astaxanthin synthase can be modified. For example, the amount of an astaxanthin synthase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of astaxanthin synthase expression by a carbon source or feedstock include RT-PCR or qRT-PCR after the host cell or microorganism has been exposed to the chosen carbon source or feedstock for varying amounts of time.

Decreasing astaxanthin synthase activity in a cell can be accomplished by modifying the amount of astaxanthin synthase protein expression in the cell, for example, by replacing the wild-type promoter of an endogenous astaxanthin synthase gene in a cell or organism with a weaker heterologous promoter, deleting or disrupting an endogenous gene, and/or replacing or modifying a gene encoding a wild-type astaxanthin synthase such that the encoded modified or substituted astaxanthin synthase protein has a reduced enzyme activity.

Modification of a Zeaxanthin Glucosyltransferase Activity

Another component of terpene biosynthesis is the conversion of zeaxanthin to zeaxanthin diglucoside. A zeaxanthin glucosyltransferase enzyme (also referred to as CrtX, UDP-glucose:zeaxanthin beta-D-glucosyltransferase; EC 2.4.1.276) can catalyze the conversion of zeaxanthin to zeaxanthin diglucoside. In some embodiments of the cells, organisms, compositions and methods provided herein, the amount and/or activity of a zeaxanthin glucosyltransferase in a cell is modified. For example, in some aspects, a cell or microorganism may be modified to increase the amount and/or activity of a zeaxanthin glucosyltransferase, may be modified to decrease the amount and/or activity of a zeaxanthin glucosyltransferase, or may be modified to alternately increase and decrease the amount and/or activity of a zeaxanthin glucosyltransferase depending, for example, on the cellular location(s) of the enzyme and/or on the conditions in which the modified cell or microorganism is cultured.

In certain aspects, the amount and/or activity of a zeaxanthin glucosyltransferase in a cell is increased. Increasing the amount and/or activity of a zeaxanthin glucosyltransferase may be particularly beneficial in embodiments in which the flux of carbons from fatty acids is directed toward a particular target product pathway (e.g., terpene production, carotenoid production, xanthophyll production, zeaxanthin diglucoside production), and away from other cellular metabolic pathways not involved in target molecule production.

In certain embodiments, zeaxanthin glucosyltransferase activity is unchanged in a host or engineered cell or organism. In some embodiments, the amount and/or activity of a host zeaxanthin glucosyltransferase can be increased by increasing the number of copies of a nucleic acid encoding a zeaxanthin glucosyltransferase (e.g., 1, 2, 3, 4, 5, 6, 7, 8, 9, 10, 15, 20, 25 or more copies of the nucleic acid); by increasing the activity of a promoter that regulates transcription of a nucleic acid encoding a zeaxanthin glucosyltransferase; or by increasing the number of copies of a nucleic acid encoding a zeaxanthin glucosyltransferase and increasing the activity of a promoter that regulates transcription of a nucleic acid encoding a zeaxanthin glucosyltransferase. In some embodiments, a zeaxanthin glucosyltransferase is endogenous to the host cell or microorganism. In one aspect of the cell or microbial systems and methods provided herein, the amount of zeaxanthin glucosyltransferase protein expressed in a cell can be increased by introducing heterologous nucleic acid encoding a zeaxanthin glucosyltransferase into a cell or microorganism. For example, introduction of heterologous nucleic acid encoding a zeaxanthin glucosyltransferase can result in increased copy number of such nucleic acids and/or provide for modification of the cellular location in which the protein is expressed. In some embodiments, a zeaxanthin glucosyltransferase is not endogenous to the host cell or microorganism. In one aspect of the cell or microbial systems and methods provided herein, a zeaxanthin glucosyltransferase protein can be expressed in a cell by introducing heterologous nucleic acid encoding a zeaxanthin glucosyltransferase into a cell or microorganism.

In some embodiments, a zeaxanthin glucosyltransferase enzyme can be a fungal or bacterial protein. In a particular embodiment, the zeaxanthin glucosyltransferase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), Chronobacter (e.g., *C. sakazakii*), *Xanthophyllomyces* (e.g., *X. dendrorhous*), or *Pantoea* (e.g., *P. ananatis*) protein.

Presence, absence or amount of zeaxanthin glucosyltransferase activity can be detected by any suitable method known in the art. For example, detection can be performed by using an appropriate zeaxanthin glucosyltransferase activity assay. Nucleic acid sequences encoding native and/or modified zeaxanthin glucosyltransferase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a zeaxanthin glucosyltransferase can be modified. For example, the amount of a zeaxanthin glucosyltransferase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of zeaxanthin glucosyltransferase expression by a carbon source or feedstock include RT-PCR or qRT-PCR after the host cell or microorganism has been exposed to the chosen carbon source or feedstock for varying amounts of time.

Decreasing zeaxanthin glucosyltransferase activity in a cell can be accomplished by modifying the amount of zeaxanthin glucosyltransferase protein expression in the cell, for example, by replacing the wild-type promoter of an endogenous zeaxanthin glucosyltransferase gene in a cell or organism with a weaker heterologous promoter, deleting or disrupting an endogenous gene, and/or replacing or modifying a gene encoding a wild-type zeaxanthin glucosyltransferase such that the encoded modified or substituted zeaxanthin glucosyltransferase protein has a reduced enzyme activity.

Modification of a Valencene Synthase Activity

Another component of terpene biosynthesis is the synthesis of valencene. A valencene synthase enzyme (also referred to as TPS1, (2E,6E)-farnesyl-diphosphate diphosphate-lyase (valencene-forming); EC 4.2.3.73) can catalyze the conversion of farnesyl diphosphate (farnesyl pyrophosphate) to valencene. In some embodiments of the cells, organisms, compositions and methods provided herein, the amount and/or activity of a valencene synthase in a cell is modified. For example, in some aspects, a cell or microorganism may be modified to increase the amount and/or activity of a valencene synthase, may be modified to decrease the amount and/or activity of a valencene synthase, or may be modified to alternately increase and decrease the amount and/or activity of a valencene synthase depending, for example, on the cellular location(s) of the enzyme and/or on the conditions in which the modified cell or microorganism is cultured.

In certain aspects, the amount and/or activity of a valencene synthase in a cell is increased. Increasing the amount and/or activity of a valencene synthase may be particularly beneficial in embodiments in which the flux of carbons from fatty acids is directed toward a particular target product pathway (e.g., terpene production, valencene production, nootkatone production) and away from other cellular metabolic pathways not involved in target molecule production.

In certain embodiments, valencene synthase activity is unchanged in a host or engineered cell or organism. In some embodiments, the amount and/or activity of a host valencene synthase can be increased by increasing the number of copies of a nucleic acid encoding a valencene synthase (e.g., 1, 2, 3, 4, 5, 6, 7, 8, 9, 10, 15, 20, 25 or more copies of the nucleic acid); by increasing the activity of a promoter that regulates transcription of a nucleic acid encoding a valencene synthase; or by increasing the number of copies of a nucleic acid encoding a valencene synthase and increasing the activity of a promoter that regulates transcription of a nucleic acid encoding a valencene synthase. In some embodiments, a valencene synthase is endogenous to the host cell or microorganism. In one aspect of the cell or microbial systems and methods provided herein, the amount valencene synthase protein expressed in a cell can be increased by introducing heterologous nucleic acid encoding a valencene synthase into a cell or microorganism. For example, introduction of heterologous nucleic acid encoding a valencene synthase can result in increased copy number of such nucleic acids and/or provide for modification of the cellular location in which the protein is expressed. In some embodiments, a valencene synthase is not endogenous to the host cell or microorganism. In one aspect of the cell or microbial systems and methods provided herein, a valencene synthase protein can be expressed in a cell by introducing heterologous nucleic acid encoding a valencene synthase into a cell or microorganism.

In some embodiments, a valencene synthase enzyme can be a fungal or bacterial protein. In a particular embodiment, the valencene synthase enzyme can be a *Candida* (e.g., *C. tropicalis, C. viswanathii, C. maltosa, C. cloacae*), *Yarrowia* (e.g., *Y. lipolytica*), *Fusarium* (e.g., *F. oxysporum*), *Bacillus* (e.g., *B. megaterium, B. subtilis*), *Chronobacter* (e.g., *C. sakazakii*), *Xanthophyllomyces* (e.g., *X. dendrorhous*), *Pantoea* (e.g., *P. ananatis*), or *Callitropsis* (e.g., *C. nootkatensis*) protein. An example of a *Callitropsis nootkatensis* nucleotide sequence (SEQ ID NO: 370) encoding a polypeptide (TPS1; SEQ ID NO: 352) having a valencene synthase activity is provided herein.

Presence, absence or amount of valencene synthase activity can be detected by any suitable method known in the art. For example, detection can be performed by using an appropriate valencene synthase activity assay. Nucleic acid sequences encoding native and/or modified valencene synthase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a nucleic acid (e.g., a heterologous nucleic acid) encoding a valencene synthase can be modified. For example, the amount of a valencene synthase protein expressed in a particular cellular location may be increased by including in the nucleic acid (e.g., heterologous nucleic acid) a strong heterologous promoter and/or a promoter that provides for a different pattern of expression in the cell or microorganism. An example of one such heterologous promoter is a *Candida* oleate-induced peroxisomal protein (POX18) gene promoter. Another example of one such heterologous promoter is a *Candida* hydratase-dehydrogenase-epimerase (HDE) gene promoter. The nucleotide sequences of a *Candida viswanathii* HDE gene promoter and a *Candida* POX18 gene promoter are provided herein as are examples of additional fatty acid-inducible promoters. In some embodiments, the promoter is modified by replacing the endogenous promoter with a promoter comprising an alkane response element (ARE1). Non-limiting examples of assays suitable for assessing induction of valencene synthase expression by a carbon source or feedstock include RT-PCR or qRT-PCR after the host cell or microorganism has been exposed to the chosen carbon source or feedstock for varying amounts of time.

Decreasing valencene synthase activity in a cell can be accomplished by modifying the amount of valencene synthase protein expression in the cell, for example, by replacing the wild-type promoter of an endogenous valencene synthase gene in a cell or organism with a weaker heterologous promoter, deleting or disrupting an endogenous gene, and/or replacing or modifying a gene encoding a wild-type valencene synthase such that the encoded modified or substituted valencene synthase protein has a reduced enzyme activity.

Modification of RAS2 Activity

RAS2 is a guanine nucleotide-binding protein that can be activated by binding GTP (e.g., in the presence of glucose). In some embodiments of the microorganisms, compositions and methods provided herein, the amount and/or activity of RAS2 in a cell is modified. For example, in some aspects, a cell or microorganism may be modified to increase RAS2 and/or RAS2 activity, may be modified to decrease RAS2 and/or RAS2 activity, or may be modified to alternately increase and decrease RAS2 and/or RAS2 activity depending, for example, on the cellular location(s) of the enzyme and/or on the conditions in which the modified cell or microorganism is cultured.

In certain aspects, the amount and/or activity of a RAS2 in a cell is decreased. Reducing or eliminating the amount and/or activity of a RAS2 may be particularly beneficial in embodiments in which the flux of carbons from fatty acids is directed toward a particular target product pathway and away from other cellular metabolic pathways involving activated fatty acids. In certain embodiments, an endogenous microbial gene encoding RAS2 (e.g., yeast RAS2 gene) can be disrupted or deleted in a host microorganism to reduce or eliminate RAS2 activity in the host relative to a microorganism in which the gene has not been modified. Methods for decreasing the amount and/or activity of RAS2 in a cell include, but are not limited to, modifying the amount of RAS2 protein expression in the cell, for example, by replacing the wild-type promoter of an endogenous RAS2 gene in a cell or organism with a weaker heterologous promoter, deleting or disrupting one or both copies of an endogenous gene, and/or replacing or modifying a gene encoding a wild-type RAS2 such that the encoded modified or substituted RAS2 protein has a reduced enzyme activity. For example, expression of a host RAS2 activity can be decreased or eliminated by disruption (e.g., knockout, insertion mutagenesis, the like and combinations thereof) of a host gene encoding the protein, or by decreasing the activity of the promoter (e.g., through addition of repressor sequences to the promoter or 5'UTR or replacing the promoter) that controls transcription of a RAS2 gene using recombinant molecular biology techniques known in the art and/or described herein. In one embodiment, a diploid yeast, such as, for example, a *Candida* yeast, when used as a host microorganism can be subjected to genetic modification in which one of the two alleles of a RAS2 gene is disrupted or deleted. In so doing, a single allele of the gene remains for a reduced amount of RAS2 expression in the microorganism and a reduced amount of the protein in the cell.

One method for disrupting an endogenous RAS2 gene is by recombinantly inserting a heterologous nucleic acid (e.g., a nucleotide sequence encoding a selectable marker such as an enzyme that restores an auxotrophic host organism to prototrophy) into the endogenous gene, thereby generating an engineered organism deficient in RAS2 activity. This can be done, for example, through homologous recombination in which a heterologous nucleic acid containing sequences of an endogenous RAS2 gene and a disrupting sequence (e.g., a knock-out gene cassette such as described herein) is introduced into a host cell or microorganism. Nucleic acids encoding a RAS2 can be obtained from a number of sources, including, for example, yeast cells. Genomic DNA from cell sources can be amplified using oligonucleotide primers based on the nucleotide sequence of a RAS2 encoding gene, including examples provided herein.

Presence, absence or amount of RAS2 activity can be detected by any suitable method known in the art. For example, detection can be performed by using an appropriate RAS2 activity assay (e.g., enzymatic assays, PCR based assays (e.g., qPCR, RT-PCR), immunological detection methods (e.g., antibodies specific for RAS2), the like and combinations thereof). Nucleic acid sequences encoding native and/or modified RAS2 sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

Carbon-Containing Products

Certain organic acids and polyketides are chemical intermediates in manufacturing processes used to make polyamides, polyurethanes and plasticizers, all of which have wide applications in producing items such as antiseptics, carpets, elastomers, food packaging, lubricants, top-grade coatings, hot-melt coating and adhesives, painting materials, corrosion inhibitor, surfactant, engineering plastics and can also be used as a starting material in the manufacture of fragrances. Some large-scale synthetic processes for making organic acids and polyketides include the use of noxious chemicals and/or solvents, some require high temperatures, and all require significant energy input. In addition, some of the processes emit toxic byproducts (such as nitrous oxide) and give rise to environmental concerns. Furthermore, chemical synthesis and extraction of desirable chemical compounds, such as terpenes, for example, from natural sources yields low product levels and is often not economically feasible. Provided herein are methods for producing organic acid and other organic chemical intermediate target molecules using biological systems provided herein. Such production systems may have significantly less environmental impact and could be economically competitive with synthetic manufacturing systems.

Organic Acids

Examples of organic acid target molecules that can be produced using compositions and methods provided herein include, but are not limited to, fatty acids, diacids and β-hydroxy acids (e.g., hydroxyalkanoate monomers) and salts and esters thereof. Fatty acids generally tend to be aliphatic acids of varying carbon chain lengths. Naturally occurring fatty acids in biological systems generally contain an even number of carbon atoms, typically between about 12 to about 24, or about 14 to about 24, and most commonly, 16 or 18 carbon atoms. Based on the number of carbons in a fatty acid carbon chain, it can be categorized as a short-, medium- or long-chain fatty acid. Generally, short-chain fatty acids have a chain length of about 2 to about 6 carbon atoms, medium-chain fatty acids have a chain length of about 8 to about 10 carbon atoms, long-chain fatty acids have a chain length of about 12 to about 20 carbon atoms and very long-chain length fatty acids have a chain length of about 22 or about 24 or more carbon atoms. The carbon atom bonds in the alkyl chain may all be single bonds (i.e., a saturated fatty acid) or may contain one or more double bonds (i.e., an unsaturated fatty acid). Unsaturated fatty acids having one double bond are also referred to as monoenoic; unsaturated fatty acids having two or more double bonds in the carbon chain are also referred to as polyenoic and polyunsaturated (PUFA). The carbon chain in a fatty acid may also be substituted with hydroxyl, methyl, or other groups in place of a hydrogen. Carboxylic acids, such as fatty acids, can partially dissociate in aqueous media and exist as undissociated, uncharged molecules and as a dissociated, anionic form.

Fatty acids containing one carboxyl group can also be referred to as monocarboxylic fatty acids. A fatty acid containing two carboxyl groups (e.g., α,ω-dicarboxylic acids) is a fatty dicarboxylic acid, also referred to herein as a diacid. An example of a diacid is adipic acid (hexanedioic acid) which contains six carbon atoms. A diacid sometimes is a C4 to a C24 diacid (i.e., a diacid containing 4 carbons to 24 carbons) and sometimes is a C8, C10, C12, C14, C16, C18, or C20 diacid. Diacids can contain an even as well as an odd number (e.g., C5, C7, C9, C11, C13, C15, C17, C19, C21 or C23) of carbons. A hydrocarbon portion of a diacid sometimes is fully saturated and sometimes a diacid includes one or more unsaturations (e.g., double bonds).

Non-limiting examples of diacids include octadecanedioic acid, decanedioic acid, dodecanedioic acid, tetradecanedioic acid, hexadecanedioic acid, octadecanedioic acid, eicosanedioic acid and other organic intermediates using biological systems. Non-limiting examples of fatty dicarboxylic acids include adipic acid (hexanedioic acid, 1,4-butanedicarboxylic acid), suberic acid (i.e., octanedioic acid, 1,8-octanedioic acid, octanedioic acid, octane-1,8-dioic acid, 1,6-hexanedicarboxylic acid, capryllic diacids), azelaic acid, sebacic acid (i.e., 1,10-decanedioic acid, decanedioic acid, decane-1,10-dioic acid, 1,8-octanedicarboxylic acid, capric diacid), undecanedioc acid, dodecanedioic acid (i.e., DDDA, 1,12-dodecanedioic acid, dodecanedioic acid, dodecane-1,12-dioic acid, 1,10-decanedicarboxylic acid, decamethylenedicaboxylic acid, 1,10-dicarboxydecane, lauric diacid), tetradecanedioic acid (i.e., TDDA, 1,14-tetradecanedioic acid, tetradecanedioic acid, tetradecane-1,14-dioic acid, 1,12-dodecanedicarboxylic acid, myristic diacid), thapsic acid (i.e., hexadecanedioic acid, 1,16-hexadecanedioic acid, hexadecanedioic acid, hexadecane-1,16-dioic acid, 1,14-tetradecanedicarboxylic acid, palmitic diacid), cis-9-hexadecenedioic acid (i.e., palmitoleic diacids), octanedioic acid (i.e., 1,18-octadecanedioic acid, octadecanedioic acid, octadecane-1,18-dioic acid, 1,16-hexadecanedicarboxylic acid, stearic diacid), cis-9-octadecenedioic acid (i.e., oleic diacids), cis-9,12-octadecenedioic acid (i.e., linoleic diacids), cis-9,12,15-octadecenedioic acid (i.e., linolenic diacids), arachidic diacid (i.e., eicosanoic diacid, icosanoic diacid), 11-eicosenoic diacid (i.e., cis-11-eicosenedioic acid), 13-eicosenoic diacids (i.e., cis-13-eicosenedioic acid), arachidonic diacid (i.e., cis-5,8,11,14-eicosatetraenedioic acid) and salts and esters of fatty acids, including, for example, any of the foregoing diacids.

Adipic acid and suberic acid are 6- and 8-carbon dicarboxylic acids, respectively, that are chemical intermediates in manufacturing processes used to make certain polyamides, polyurethanes and plasticizers. Azelaic acid, a 9-carbon dicarboxylic acid, is also used in therapeutic compositions due to its antibacterial and keratolytic activities. Sebacic acid, a 10-carbon dicarboxylic acid, is also used in cosmetics and candles and as an intermediate in producing aromatics and antiseptics. Dodecandioic acid (DDDA), a 12-carbon dicarboxylic acid, is widely used in forming polyamides, such as nylon. Some large-scale industrial processes for making adipic acid include (i) liquid phase oxidation of ketone alcohol oil (KA oil); (ii) air oxidation/hydration of cyclohexane with boric acid to make cyclohexanol, followed by oxidation with nitric acid; and (iii) hydrocyanation of butadiene to a pentenenitrile mixture, followed by hydroisomerization of adiponitrile, followed by hydrogenation. Suberic acid can be synthetically manufactured by oxidation of cyclooctene with ozone oxygen or ozone $H_2O_2$. Methods of chemical synthesis of sebacic acid include alkaline cleavage of ricinoleic acid and electrolytic dimerization of monomethyl adipate. DDDA is synthetically produced from butadiene in a multistep chemical process. These energy-requiring processes involve the use and/or production of toxic chemicals and/or solvents.

3-hydroxypropionic acid (3-HP or 3HP, used interchangeably herein, which collectively refers to 3-hydroxypropionic acid, a 3-hydroxypropionate salt or ester thereof, or mixtures thereof in any proportion) is a platform chemical that can be converted into a variety of valuable products such as poly (hydroxypropionate), 1,3-propanediol, ethyl 3-ethoxypropionate (EEP), malonic acid and acrylic acid. For example, 3-HP can be dehydrated to produce acrylic acid, which in turn can be esterified to produce methyl acrylate or aminated to produce acrylamide. Acrylamide can further be converted by dehydration to acrylonitrile, acrylonitrile can be condensed to produce adiponitrile and adiponitrile can be hydrolysed to produce hexamethylenediamine (HMDA). In addition, polymerized acrylic acid (with itself or with other monomers such as acrylamide, acrylonitrile, vinyl, styrene, or butadiene) can produce a variety of homopolymers and copolymers that are used in the manufacture of various plastics, coatings, adhesives, elastomers, latex applications, emulsions, leather finishings, and paper coating, as well as floor polishes and paints. Acrylic acid also can be used as a chemical intermediate for the production of acrylic esters such as ethyl acrylate, butyl acrylate, methyl acrylate, and 2-ethyl hexyl acrylate and superabsorbent polymers (glacial acrylic acid).

Polyketides

Polyketides are secondary metabolites polymerized from short-chain carboxylic acid units (e.g., acetate, proprionate, malonate and butyrate). Many polyketide-derived molecules are valuable pharmaceuticals such as antibiotics, antitumor agents and cholesterol-lowering drugs. Non-limiting examples of polyketides include triacetic acid lactone (TAL or 4-hydroxy-6-methyl-2-pyrone, used interchangeably herein) and 6-methylsalicylic acid (6-MSA or 2-hydroxy-6-methylbenzoic acid). TAL can be converted into end products such as sorbic acid and 1,3-pentadiene, and can serve as a precursor in the synthesis of compounds (e.g, phloroglucinol and resorcinol) used in production of resin and adhesive formulations.

Terpenes

Terpenes are made up of units of isoprene ($C_5H_8$) (isoprene, methylbuta-1,3-diene, hemiterpene are used interchangeably herein) that can be joined together in a variety of different combinations to generate thousands of terpene compounds. Terpenes can be categorized according to the number of isoprene units contained in the molecule: monoterpenes (2 isoprene units), sesquiterpenes (3 isoprene units), diterpenes (4 isoprene units), sesterterpenes (5 isoprene units), triterpenes (6 isoprene units), sesquaterpenes (7 isoprene units), tetraterpenes (8 isoprene units), polyterpenes (many isoprene units). The isoprene units can be joined "head-to-tail" in a linear chain or arranged in rings. Terpenes can be hydrocarbons or can contain other atoms, such as oxygen (e.g., alcohols, aldehydes and ketones) which are typically referred to as terpenoids. Terpenes are commercially valuable compounds with a variety of uses in the healthcare, food, cosmetics and chemical industries, including, but not limited to, uses as pharmaceuticals (e.g., anticancer and antimalarial drugs), nutraceuticals, supplements, antioxidants, fragrances, flavoring agents, food colorants and agricultural pest control agents. Included in the tetraterpenes are organic pigments (e.g., β-carotene and astaxanthin) referred to as carotenoids. These terpenes have many uses such as, for example, additives in food and feed stocks, precursors to vitamin A, antioxidants and supplements (e.g., lutein and lycopene).

Cellular Carbon Flux

Cells can obtain carbon atoms from external carbon sources such as, for example, carbohydrates, hydrocarbons, acids and alcohols. Upon entering the cell, the source molecule is metabolized through various chemical reactions depending on the carbon source, as well as other factors (e.g., oxygen and nutrient availability). Carbon atoms flow or flux through these metabolic reactions and are utilized in generating energy and in the production of cellular materials. The multiple series of coordinated reactions involved in metabolizing different carbon sources for different purposes are referred to as metabolic pathways and can be catabolic or anabolic. In catabolic pathways, the carbon source is broken down through oxidative reactions in which electrons are removed from substrates or intermediates, and, in the process, energy is generated and stored as adenosine triphosphate (ATP). Glycolysis is an example of a catabolic pathway in which a carbohydrate carbon source (e.g., glucose) is converted to pyruvate which is oxidatively decarboxylated to acetyl-CoA by the pyruvate dehydrogenase multi-enzyme complex in the mitochondria of eukaryotic cells and in the cytosol of prokaryotic cells. In this series of reactions, a multi-carbon source molecule is degraded into a 2-carbon acetyl group and carbon dioxide. The 2 carbons of the acetyl group are then incorporated into a citrate molecule in the tricarboxylic acid cycle (also referred to as the TCA, citric acid and Krebs cycle) in which additional ATP molecules are generated. Intermediates in the TCA cycle (e.g., citrate, α-ketoglutarate, succinyl-CoA and oxaloacetate) provide precursors in the synthesis of essential cellular components such as amino acids, fatty acids, nucleotides and porphyrins. The TCA cycle is considered an amphibolic pathway which combines both catabolic and anabolic functions. In another catabolic pathway, β-oxidation, a fatty acid carbon source is broken down into acetyl-CoA and chain-shortened acyl-CoA which in turn can enter another cycle of β-oxidation for further degradation. The acetyl-CoA molecules generated in β-oxidation, which occurs in peroxisomes in eukaryotic microorganisms and the cytosol of prokaryotic cells, are then utilized in ATP generation in the TCA cycle.

Acetyl-CoA generated through β-oxidation in microorganisms (e.g., yeast and bacteria) can also be used in the glyoxylate cycle, which is an anabolic pathway wherein 2-carbon acetyl units are converted to 4-carbon molecules that can be used for the biosynthesis of macromolecules. The glyoxylate cycle thus allows these microorganisms to utilize non-fermentable carbon sources, such as fatty acids, acetate and ethanol, as a sole carbon source. In the glyoxylate cycle, which is similar to the TCA cycle, isocitrate is cleaved directly into the 4-carbon succinate molecule, and the 2-carbon glyoxylate molecule, through the enzyme isocitrate lyase without the two decarboxylation steps that occur in the same conversion in the TCA cycle. Glyoxylate then condenses with acetyl-CoA generated through β-oxidation to produce malate which in turn is converted to oxaloacetate and then isocitrate. Succinate generated in the glyoxylate cycle can also reenter the TCA cycle to produce oxaloacetate. Malate and oxaloacetate produced in the glyoxylate cycle can be converted into phosphoenolpyruvate, which is the product of the first enzyme-catalyzed reaction in gluconeogenesis. Gluconeogenesis is another anabolic pathway and provides for synthesis of carbohydrates when non-carbohydrate carbon sources are available to cells. Microorganisms growing on non-fermentable carbon sources utilize gluconeogenesis to synthesize glucose-6-phosphate which is used in the synthesis of ribonucleotides and deoxyribonucleotides. The carbon skeletons for generation of glucose-6-phosphate are contained within oxaloacetate from the glyoxylate and TCA cycles. In gluconeogenesis, oxaloacetate is converted into pyruvate through phosphoenolpyruvate carboxykinase, followed by several reactions that ultimately yield glucose-6-phosphate.

Additional anabolic pathways in cells include reactions in the synthesis of lipids, including, for example, triacylglycerols (referred to interchangeably as triglycerides and TAG) and phospholipids. Lipids are a diverse group of compounds that are soluble in non-polar organic solvents but not in water. Fatty acids serve as building blocks in the synthesis of storage lipids (e.g., triacylglycerols and steryl esters) and membrane lipids (e.g., phospholipids and sphingolipids). For example, triacylglycerol is an ester of glycerol and three fatty acids. In the synthesis of triacylglycerols from free fatty acids internalized into microbial cells from the environment, the fatty acids are first activated with coenzyme A to form an acyl-CoA. The acyl-CoA is involved in two pathways of triacylglycerol synthesis: the glycerol-3-phosphate (G3P) pathway and the dihydroxyacetone phosphate (DHAP) pathway. Both pathways proceed through formation of phosphatidic acid and subsequently diacylglycerol which is then acetylated to form triacylglycerol. Phosphatidic acid can also be converted to cytidine diphosphate-diacylglycerol which is the precursor of all major phospholipids in cells.

Modification of Cellular Carbon Flux

The multiple routes of carbon metabolism in cells provide opportunities for loss of carbon from a production pathway for desired organic molecules in a cell. Such losses can result in decreased product yields, increased production times and costs, and overall decreased production process efficiency and economy. Cells, organisms and microorganisms and methods described herein provide systems for enhanced production of target molecules. In one aspect, production is enhanced through alteration of carbon flux in cell-based and microbial production systems. Through alteration of cellular carbon flux, carbon atoms that may have flowed or been transported into other metabolic processes (e.g., energy and/or cellular composition generation) in a cell are redirected and/or recycled and made available for use in organic target molecule production processes. In so doing, starting material loss is reduced and carbon sources are utilized to a fuller extent in the production of the desired molecules.

Acetyl Coenzyme A

Acetyl coenzyme A (acetyl-CoA; used interchangeably herein) is a major precursor in cell-based or microbial production of many industrially important chemicals. The fatty acid biosynthesis pathway begins with the conversion of acetyl-CoA to malonyl-CoA. Similarly, organic acids, such as, for example 3-hydroxypropionic acid, and polyketides, such as triacetic acid lactone, can be synthesized using acetyl-CoA as a starting material. Additional high-value products that can be synthesized in reactions beginning with acetyl-CoA include terpenes, which can be generated from isopentenyl diphosphate produced through microbial mevalonate pathways in cells. Acetyl-CoA is formed from an acetyl group and coenzyme A (a derivative of pantothenate and cysteine) which are linked through a thioester bond. Acetyl-CoA is a central metabolite in carbon metabolism. It is the final carbon form resulting from the catabolism of external carbon sources and is the initial precursor carbon form in many of the cellular anabolic pathways and energy generation processes. Acetyl-CoA is formed in multiple locations of a eukaryotic cell depending on the metabolic pathway and/or carbon source through which it is generated. For example, acetyl-CoA generated through glycolysis is localized in the mitochondria, whereas acetyl-CoA generated through peroxisomal β-oxidation is localized to peroxisomes. Acetyl-CoA generated through metabolism of acetate or ethanol is localized to the cytoplasm. Typically, acetyl-CoA formed in any of these cellular locations is transferred to the mitochondrial matrix for use in the TCA cycle for the generation of energy and precursors of cellular constituents, although some acetyl-CoA localized to the cytoplasm can be used in the synthesis of oxaloacetate via initial conversion to malate.

Acetyl-CoA, due to its chemical nature, cannot freely cross biological membranes. Therefore, acetyl-CoA formed in peroxisomes and the cytoplasm is modified for transport to the mitochondria. The primary mechanism for transfer of acetyl-CoA into the mitochondria in eukaryotic cells is the carnitine shuttle in which the acetyl group of acetyl-CoA is reversibly linked to a carrier molecule, carnitine, which is able to traverse biological membranes. Acetyl-carnitine is generated and degraded by the action of carnitine acetyltransferases (e.g., EC 2.3.1.7). Peroxisomal acetyl-CoA not destined for the glyoxylate cycle is converted to acetyl-carnitine by carnitine O-acetyltransferase. Due to its smaller size compared to acetyl-CoA, acetyl-carnitine is able to diffuse through pores in the peroxisomal membrane, across the cytoplasm to mitochondria where it is converted back to acetyl-CoA by mitochondrial carnitine O-acetyltransferase. Yeast also have carnitine acetyltransferases that localize to the cytosol and/or to the outer mitochondrial membrane which, in some species, are encoded by YAT1 genes. The enzymes encoded by these genes may convert cytosolic acetyl-carnitine to acetyl-CoA and carnitine.

Acetyl-carnitine uptake into mitochondria involves an acetyl-carnitine translocase which, in some yeast species, is encoded by a CRC1 gene. Mitochondria possess two membranes with the outer membrane allowing free diffusion of metabolites and the inner membrane controlling metabolite transport with multiple membrane transport proteins. A mitochondrial inner-membrane transport protein (e.g., Crc1p) may function as an acetyl-carnitine transporter providing for transport of acetyl-carnitine into the mitochondrial matrix.

Certain aspects of the cells, microorganisms, compositions and methods provided herein involve cellular carbon flux modifications to capture the carbon atoms in the acetyl group of acetyl-CoA formed in cellular metabolism. In some embodiments, carbon flux is modified to capture acetyl group carbon atoms generated in organelles (e.g., peroxisomes) or membranes as they are transported through the cytosol in the form of acetyl-carnitine. In other embodiments, acetyl group carbons of organelle-generated acetyl-CoA are re-directed from the carnitine-assisted transport system and toward conversion to acetate. Acetate, unlike acetyl-CoA, is able to traverse membranes and enter the cytosol from organelles. In further embodiments, carbon atoms of acetyl groups in mitochondrial acetyl-CoA can also be captured from intermediates of the TCA cycle that move into the cytosol.

Acetyl-Carnitine Capture/Conversion

Included in embodiments of the cells, microorganisms, compositions and methods provided herein are cell-based or microbial production platform systems and components thereof in which the amount of (a) acetyl-carnitine in the cell cytosol is modified and/or (b) carnitine acetyltransferase and/or carnitine acetyltransferase activity in the cell cytosol is/are modified. In some instances, the amount of (a) acetyl-carnitine in the cell cytosol is increased and/or decreased and/or (b) carnitine acetyltransferase and/or carnitine acetyltransferase activity in the cell cytosol is/are increased and/or decreased. For example, in some aspects, a cell or microorganism may be modified to increase cytosolic acetyl-carnitine, may be modified to decrease cytosolic acetyl-carnitine or may be modified to alternately increase and decrease cytosolic acetyl-carnitine depending on the conditions in which the modified cell or microorganism is cultured.

In one embodiment, the amount of acetyl group carbons in the cytosol in the form of acetyl-carnitine in transit from the peroxisome and other areas to the mitochondria is increased in a cell or microorganism through a reduction in, and/or slowing of, the entry of acetyl-carnitine into mitochondria from the cytosol. This provides an increased availability of substrate for cytosolic carnitine acetyltransferase to convert to acetyl-CoA, and effectively results in an increase in the generation of cytosolic acetyl-CoA. Some of the acetyl group carbons are thereby diverted from the mitochondria, and from utilization in metabolic processes therein, and are instead retained in the cytosol. In some embodiments, the amount and/or activity of carnitine acetyltransferase in the cytosol of a cell or microorganism is/are increased. This provides an increased conversion of acetyl-carnitine, such as that which is in transit from the peroxisome to the mitochondria, into acetyl-CoA in the cytosol. In some embodiments, the entry of acetyl-carnitine into mitochondria from the cytosol is reduced in a cell or microorganism, and the amount and/or activity of carnitine acetyltransferase in the cytosol of the cell or microorganism is/are increased.

Acetate Capture/Conversion

Included in embodiments of the microorganisms, compositions and methods provided herein are microbial production platform systems and components thereof in which acetyl group carbons of organelle-generated acetyl-CoA are directed toward conversion to acetate. Modification of carbon flux in this manner provides for a tight and precise control of the movement of the acetyl carbons because acetate may pass through some membranes, e.g., peroxisomal membranes, more readily than other membranes, e.g., mitochondrial inner membranes. Therefore, carbon atoms captured in the form of cytosolic acetate will be less readily transported into mitochondria for further metabolism, unlike carbon atoms captured in the form of cytosolic acetyl-carnitine. Provided herein are cells, microorganisms, compositions and methods in which cellular carbon flux has been modified through the altered de novo generation of cellular acetate. In particular embodiments, cellular carbon flux has been modified to increase the production of acetate in a cell and/or a particular cellular location. For example, in certain aspects, cells are modified to increase the production of acetate in peroxisomes. In some embodiments, acetyl group carbons are directed toward conversion to acetate and away from the carnitine-carrier transport system.

In embodiments in which modification of cellular acetate generation yields increased amounts of cytosolic acetate, the amount and/or activity of cytosolic acetyl-CoA synthetase (also referred to as ACS or acetate-CoA ligase and used interchangeably herein) can also be increased to provide for increased conversion of acetate to acetyl-CoA. For example, the genomic copy number of nucleic acids encoding acetyl-CoA synthetase can be increased and/or the promoter for the acetyl-CoA synthetase-encoding nucleic acid can be replaced with a stronger promoter or one that provides for a different pattern of expression in the cell or microorganism.

Citrate Capture/Conversion

Carbon atoms of acetyl groups in mitochondrial acetyl-CoA can also be captured from intermediates of the TCA cycle such as, for example, citrate molecules generated in the first step of the cycle through the citrate synthase-catalyzed condensation of acetyl-CoA and oxaloacetate. In another embodiment of the cell and microbial production systems and methods provided herein, carbon atoms incorporated into citrate that has been transferred to the cytosol are captured through the cleavage of citrate to oxaloacetate and acetyl-CoA by the enzyme ATP citrate lyase (i.e., ACL, used interchangeably herein). The capture of metabolite carbon in this manner diverts it from use in other metabolic processes and also results in an increase in the level cytoplasmic acetyl-CoA.

Acyl Coenzyme A

Acyl-CoA synthetases (e.g., EC 6.2.1.3) are enzymes that catalyze the activation of free fatty acids in the cytoplasm into CoA esters (fatty acyl-CoA) which are involved in several metabolic pathways. For example, free fatty acids internalized into cells that become activated with coenzyme A to form an acyl-CoA are used in the synthesis of triacylglycerols via two pathways: the glycerol-3-phosphate (G3P) pathway and the dihydroxyacetone phosphate (DHAP) pathway. When free fatty acids are activated and used in cellular processes, such as lipid biosynthesis, the carbon atoms in the free fatty acids are not available for use in cell or microbial production of commercially important chemicals. Certain aspects of the cells, microorganisms, compositions and methods provided herein include one or more modifications to reduce or eliminate cytosolic activation of free fatty acids into acyl-CoA. An example of a modification to reduce or eliminate activation of cytosolic free fatty acids is reduction or elimination of the amount and/or activity of acyl-CoA synthetase in the cytoplasm.

Malonyl-CoA

Malonyl-CoA is a coenzyme A derivative of the dicarboxylic acid malonic acid that can serve as a precursor in the synthesis of numerous valuable organic molecules, including fatty acids and polyketides. Cytoplasmic acetyl-CoA can be converted to malonyl-CoA by the enzyme acetyl-CoA carboxylase (e.g., EC 6.4.1.2). A modification of cellular carbon flux that increases cytosolic acetyl-CoA alone may not be optimal for enhancing fatty acid or other organic acid production in an engineered cell or microbial system if there is not a concurrent increase in conversion of acetyl-CoA to malonyl-CoA. To maximize production efficiencies, included in the cells, microorganisms, compositions and methods provided herein are cellular carbon flux modifications that increase the amount of cytosolic malonyl-CoA.

Cells and Organisms

Provided herein are modified cells and organisms. In particular embodiments, the modified cells and organisms have been manipulated in ways designed to alter the cellular flux of carbon to direct carbon atoms toward one or more biochemical events or cellular locations and/or away from other metabolic pathways or locations. Also provided herein are methods of producing modified cells and organisms.

Host Cells and Organisms

Modified cells and organisms provided herein can be generated by manipulation of an existing cell or organism. The terms "host," "starting" or "parental" as used herein in reference to a cell or organism refers to such an existing cell or organism. Host cells and organisms include, for example, wild-type or native cells or organisms as they occur in nature in their genetically unmodified, predominant form, and mutant cells or organisms that have one or more genetic differences compared to a wild-type cell or organism. A host cell or organism can also be a cell or organism that has been genetically modified. A host cell or organism thus serves as a reference cell or organism with respect to a modified or engineered cell or organism obtained by manipulation of a host. Organisms or cells that can be used as host organisms or cells, or as a source for a nucleic acid, are publicly available, from, for example, American Type Culture Collection (Manassas, Virginia), Thermo Fisher Scientific (Waltham, MA) and Agricultural Research Culture Collection (NRRL; Peoria, Illinois).

Host or modified organisms include multicellular and single cell, or unicellular, organisms. Microscopic organisms, referred to interchangeably herein as a "microorganism," "microbial cell" or "microbe," are an example of a host or modified organism and are included in the term "organism." Many microorganisms are unicellular and often are capable of dividing and proliferating. Cells from non-microbial organisms can also be utilized as a host or modified organism or source for a heterologous polynucleotide.

Organisms can be prokaryotic (e.g., bacteria) and non-prokaryotic (e.g., eukaryotic). Examples of eukaryotic organisms include yeast, filamentous fungi, protists, plants, algae and amoeba. An organism or microorganism can include one or more of the following features: aerobe, anaerobe, filamentous, non-filamentous, monoploid, haploid, diploid, oleaginous, non-oleaginous, auxotrophic and/or non-auxotrophic.

Host cells or organisms or modified cells or organisms can be selected based on a variety of criteria depending, for example, on the methods of generating modified cells or organisms therefrom and the uses of the modified cells or organisms from which they are derived. Selection criteria can include inherent metabolic mechanisms, suitability for genetic manipulation, adaptability to a variety of or particular growth or culture conditions, and ease of large-scale maintenance for use in industrial production processes. For example, microorganisms often can be cultured at cell densities useful for industrial production of a target product, including in a fermentation device. Included among microorganisms that may be selected as a host or modified organism or source for a heterologous polynucleotide are fungi. Examples of fungi include, but are not limited to, yeast, *Aspergillus* fungi (e.g., *A. parasiticus*, *A. nidulans*), *Thraustochytrium* fungi, *Schizochytrium* fungi and *Rhizopus* fungi (e.g., *R. arrhizus*, *R. oryzae*, *R. nigricans*). In some embodiments, a host organism can be a fungus such as a yeast strain, an *A. parasiticus* strain that includes, but is not limited to, strain ATCC 24690, and in certain embodiments, a fungus is an *A. nidulans* strain that includes, but is not limited to, strain ATCC 38163.

In some embodiments, a modified cell or microorganism provided herein can be derived from any one of the following cell lines: ATCC 20362, ATCC 8862, ATCC 18944, ATCC 20228, ATCC 76982, LGAM S(7)1, ATCC 20336, ATCC 20913, SU-2 (ura3-/ura3-), ATCC 20962, ATCC 24690, ATCC 38164, ATCC 38163, H5343, ATCC 8661, ATCC 8662, ATCC 9773, ATCC 15586, ATCC 16617, ATCC 16618, ATCC 18942, ATCC 18943, ATCC 18944, ATCC 18945, ATCC 20114, ATCC 20177, ATCC 20182, ATCC 20225, ATCC 20226, ATCC 20228, ATCC 20237, ATCC 20255, ATCC 20287, ATCC 20297, ATCC 20306, ATCC 20315, ATCC 20320, ATCC 20324, ATCC 20341, ATCC 20346, ATCC 20348, ATCC 20362, ATCC 20363, ATCC 20364, ATCC 20372, ATCC 20373, ATCC 20383, ATCC 20390, ATCC 20400, ATCC 20460, ATCC 20461, ATCC 20462, ATCC 20496, ATCC 20510, ATCC 20628, ATCC 20688, ATCC 20774, ATCC 20775, ATCC 20776, ATCC 20777, ATCC 20778, ATCC 20779, ATCC 20780, ATCC 20781, ATCC 20794, ATCC 20795, ATCC 20875, ATCC 22421, ATCC 22422, ATCC 22423, ATCC 22969, ATCC 32338, ATCC 32339, ATCC 32340, ATCC 32341, ATCC 32342, ATCC 32343, ATCC 32935, ATCC 34017, ATCC 34018, ATCC 34088, ATCC 34922, ATCC 38295, ATCC 42281, ATCC 44601, ATCC 46025, ATCC 46026, ATCC 46027, ATCC 46028, ATCC 46067, ATCC 46068, ATCC 46069, ATCC 46070, ATCC 46330, ATCC 46482, ATCC 46483, ATCC 46484, ATCC 48436, ATCC 60594, ATCC 62385, ATCC 64042, ATCC 74234, ATCC 76598, ATCC 76861, ATCC 76862, ATCC 90716, ATCC 90806, ATCC 90811, ATCC 90812, ATCC 90813, ATCC 90814, ATCC 90903, ATCC 90904, ATCC 90905, ATCC 96028, ATCC 201089, ATCC 201241, ATCC 201242, ATCC 201243, ATCC 201244, ATCC 201245, ATCC 201246, ATCC 201247, ATCC 201248, ATCC 201249, ATCC 201847, ATCC MYA-165, ATCC MYA-166, ATCC MYA-2613, and ATCC MYA-4467. That is, in certain embodiments, an engineered cell or microorganism described herein can be generated from one or more of the aforementioned ancestral cell lines.

Yeast that can serve as a host organism, and that can be modified organisms, include, but are not limited to, ascomycetes, non-*Saccharomyces* ascomycetes, and basidiomycetes. Non-limiting examples of yeast include *Yarrowia* yeast (e.g., *Y. lipolytica* (formerly classified as *Candida lipolytica*)), *Candida* yeast (e.g., *C. revkaufi, C. viswanathii, C. pulcherrima, C. tropicalis, C. utilis*), *Blastobotrys* (formerly classified as *Arxula*) (e.g., *Blastobotrys adeninivorans* (formerly classified as *Arxula adeninivorans*), *Blastobotrys mokoenaii*), *Rhodotorula* yeast (e.g., *R. glutinus, R. graminis*), *Rhodosporidium* yeast (e.g., *R. toruloides*), *Saccharomyces* yeast (e.g., *S. cerevisiae, S. bayanus, S. pastorianus, S. carlsbergensis*), *Cryptococcus* yeast, *Trichosporon* yeast (e.g., *T. pullans, T. cutaneum*), *Pichia* yeast (e.g., *P. pastoris*) and *Lipomyces* yeast (e.g., *L. starkeyii, L. lipoferus*). In some embodiments, a suitable yeast is of the genus *Arachniotus, Aspergillus, Aureobasidium, Auxarthron, Blastobotrys, Blastomyces, Candida, Chrysosporuim, Debaryomyces, Coccidiodes, Cryptococcus, Gymnoascus, Hansenula, Histoplasma, lssatchenkia, Kluyveromyces, Lipomyces, Lssatchenkia, Microsporum, Myxotrichum, Myxozyma, Oidiodendron, Pachysolen, Penicillium, Pichia, Rhodosporidium, Rhodotorula, Saccharomyces, Schizosaccharomyces, Scopulariopsis, Sepedonium, Trichosporon,* or *Yarrowia*. In some embodiments, a suitable yeast is of the species *Arachniotus flavoluteus, Aspergillus flavus, Aspergillus fumigatus, Aspergillus niger, Aureobasidium pullulans, Auxarthron thaxteri, Blastobotrys adeninivorans, Blastomyces dermatitidis, Candida albicans, Candida dubliniensis, Candida famata, Candida glabrata, Candida guilliermondii, Candida kefyr, Candida krusei, Candida lambica, Candida lipolytica, Candida lustitaniae, Candida parapsilosis, Candida pulcherrima, Candida revkaufi, Candida rugosa, Candida tropicalis, Candida utilis, Candida viswanathii, Candida xestobii, Chrysosporuim keratinophilum, Coccidiodes immitis, Cryptococcus albidus* var. *diffluens, Cryptococcus laurentii, Cryptococcus neofomans, Debaryomyces hansenii, Gymnoascus dugwayensis, Hansenula anomala, Histoplasma capsulatum, Issatchenkia occidentalis, Isstachenkia orientalis, Kluyveromyceslactis, Kluyveromyces marxianus, Kluyveromyces thermotolerans, Kluyveromyces waltii, Lipomyces lipoferus, Lipomyces starkeyii, Microsporum gypseum, Myxotrichum deflexum, Oidiodendron echinulatum, Pachysolen tannophilis, Penicillium notatum, Pichia anomala, Pichia pastoris, Pichia stipitis, Rhodosporidium toruloides, Rhodotorula glutinus, Rhodotorula graminis, Saccharomyces cerevisiae, Saccharomyces kluyveri, Schizosaccharomyces pombe, Scopulariopsis acremonium, Sepedonium chrysospermum, Trichosporon cutaneum, Trichosporon pullans, Yarrowia lipolytica,* or *Yarrowia lipolytica* (formerly classified as *Candida lipolytica*). In some embodiments, a yeast is a *Y. lipolytica* strain that includes, but is not limited to, ATCC 20362, ATCC 8862, ATCC 18944, ATCC 20228, ATCC 76982 and LGAM S(7)1 strains (Papanikolaou S., and Aggelis G., *Bioresour. Technol.* 82(1):43-9 (2002)).

In certain embodiments, a yeast is a *C. tropicalis* strain, a *C. viswanathii* strain, a *Y. lipolytica* strain or a yeast strain that includes, but is not limited to, ATCC 20336, ATCC 20913, SU-2 (ura3-/ura3-), ATCC 20962, H5343 (beta oxidation blocked; U.S. Pat. No. 5,648,247) ATCC 20362, ATCC 8862, ATCC 18944, ATCC 20228, ATCC 76982, LGAM S(7)1, ATCC 8661, ATCC 8662, ATCC 9773, ATCC 15586, ATCC 16617, ATCC 16618, ATCC 18942, ATCC 18943, ATCC 18944, ATCC 18945, ATCC 20114, ATCC 20177, ATCC 20182, ATCC 20225, ATCC 20226, ATCC 20228, ATCC 20237, ATCC 20255, ATCC 20287, ATCC 20297, ATCC 20306, ATCC 20315, ATCC 20320, ATCC 20324, ATCC 20341, ATCC 20346, ATCC 20348, ATCC 20362, ATCC 20363, ATCC 20364, ATCC 20372, ATCC 20373, ATCC 20383, ATCC 20390, ATCC 20400, ATCC 20460, ATCC 20461, ATCC 20462, ATCC 20496, ATCC 20510, ATCC 20628, ATCC 20688, ATCC 20774, ATCC 20775, ATCC 20776, ATCC 20777, ATCC 20778, ATCC 20779, ATCC 20780, ATCC 20781, ATCC 20794, ATCC 20795, ATCC 20875, ATCC 22421, ATCC 22422, ATCC 22423, ATCC 22969, ATCC 32338, ATCC 32339, ATCC 32340, ATCC 32341, ATCC 32342, ATCC 32343, ATCC 32935, ATCC 34017, ATCC 34018, ATCC 34088, ATCC 34922, ATCC 38295, ATCC 42281, ATCC 44601, ATCC 46025, ATCC 46026, ATCC 46027, ATCC 46028, ATCC 46067, ATCC 46068, ATCC 46069, ATCC 46070, ATCC 46330, ATCC 46482, ATCC 46483, ATCC 46484, ATCC 48436, ATCC 60594, ATCC 62385, ATCC 64042, ATCC 74234, ATCC 76598, ATCC 76861, ATCC 76862, ATCC 90716, ATCC 90806, ATCC 90811, ATCC 90812, ATCC 90813, ATCC 90814, ATCC 90903, ATCC 90904, ATCC 90905, ATCC 96028, ATCC 201089, ATCC 201241, ATCC 201242, ATCC 201243, ATCC 201244, ATCC 201245, ATCC 201246, ATCC 201247, ATCC 201248, ATCC 201249, ATCC 201847, ATCC MYA-165, ATCC MYA-166, ATCC MYA-2613, and ATCC MYA-4467.

In certain embodiments, a yeast is a *Candida* species (i.e., *Candida* spp.) yeast. In some embodiments, suitable *Candida* species include, but are not limited to *Candida albicans, Candida dubliniensis, Candida famata, Candida glabrata, Candida guilliermondii, Candida kefyr, Candida krusei, Candida lambica, Candida lipolytica, Candida lustitaniae, Candida parapsilosis, Candida pulcherrima, Candida revkaufi, Candida rugosa, Candida tropicalis, Candida utilis, Candida viswanathii, Candida xestobii* and any other *Candida* spp. yeast described herein. Non-limiting examples of *Candida* spp. strains include, but are not limited to, sAA001 (ATCC 20336), sAA002 (ATCC 20913), sAA003 (ATCC 20962), sAA496 (US2012/0077252), sAA106 (US2012/0077252), SU-2 (ura3-/ura3-), H5343 (beta oxidation blocked; U.S. Pat. No. 5,648,247) strains. Any suitable strains from *Candida* spp. yeast may be utilized as parental strains for modification.

Examples of ascomycetes fungi include, but are not limited to, *Candida* spp., *Yarrowia* spp., *Blastobotrys* spp., *Aspergillus* spp., *Penicillium* spp., *Saccharomyces* spp., *Debaryomyces* spp., *Lipomyces* spp., *Fusarium* spp., *Paecilomyces* spp., *Trichoderma* spp., *Cladosporium* spp., *Pichia* spp., and *Neurospora* spp. Examples of basidiomycetes fungi include, but are not limited to, *Trichosporon* spp., *Rhodotorula* spp., *Rhodosporidium* spp., *Cryptococcus* spp., *Phaffia* spp., and *Xanthophyllomyces* spp.

Prokaryote organisms that can serve as host organisms, and that can be modified organisms, include, for example, Gram negative or Gram positive bacteria. Examples of bacteria include, but are not limited to, *Bacillus* (e.g., *B. subtilis*, *B. megaterium*), *Acinetobacter*, *Norcardia*, *Xanthobacter*, *Escherichia* (e.g., *E. coli* (e.g., strains DH10B, Stbl2, DH5-alpha, DB3, DB3.1), DB4, DBS, JDP682 and ccdA-over (e.g., U.S. application Ser. No. 09/518,188))), *Streptomyces*, *Erwinia*, *Klebsiella*, *Serratia* (e.g., *S. marcessans*), *Pseudomonas* (e.g., *P. aeruginosa*), *Salmonella* (e.g., *S. typhimurium*, *S. typhi*), *Megasphaera* (e.g., *Megasphaera elsdenii*). Bacteria also include, but are not limited to, photosynthetic bacteria (e.g., green non-sulfur bacteria (e.g., *Choroflexus* (e.g., *C. aurantiacus*), *Chloronema* (e.g., *C. gigateum*)), green sulfur bacteria (e.g., *Chlorobium* bacteria (e.g., *C. limicola*), *Pelodictyon* (e.g., *P. luteolum*), purple sulfur bacteria (e.g., *Chromatium* (e.g., *C. okenii*)), and purple non-sulfur bacteria (e.g., *Rhodospirillum* (e.g., *R. rubrum*), *Rhodobacter* (e.g., *R. sphaeroides*, *R. capsulatus*), and *Rhodomicrobium* (e.g., *R. vanellii*)).

Examples of cells from non-microbial organisms that can be utilized as a host cell or organism, engineered cell or organism or source for a heterologous polynucleotide include, but are not limited to, insect cells (e.g., *Drosophila* (e.g., *D. melanogaster*), *Spodoptera* (e.g., *S. frugiperda* Sf9 or Sf21 cells) and *Trichoplusa* (e.g., High-Five cells); nematode cells (e.g., *C. elegans* cells); avian cells; amphibian cells (e.g., *Xenopus laevis* cells); reptilian cells; mammalian cells (e.g., NIH3T3, 293, CHO, COS, VERO, C127, BHK, Per-C6, Bowes melanoma and HeLa cells); and plant cells (e.g., *Arabidopsis thaliana*, *Nicotania tabacum*, *Cuphea acinifolia*, *Cuphea aequipetala*, *Cuphea angustifolia*, *Cuphea appendiculata*, *Cuphea avigera*, *Cuphea avigera* var. *pulcherrima*, *Cuphea axilliflora*, *Cuphea bahiensis*, *Cuphea baillonis*, *Cuphea brachypoda*, *Cuphea bustamanta*, *Cuphea calcarata*, *Cuphea calophylla*, *Cuphea calophylla* subsp. *mesostemon*, *Cuphea carthagenensis*, *Cuphea circaeoides*, *Cuphea confertiflora*, *Cuphea cordata*, *Cuphea crassiflora*, *Cuphea cyanea*, *Cuphea decandra*, *Cuphea denticulata*, *Cuphea disperma*, *Cuphea epilobiifolia*, *Cuphea ericoides*, *Cuphea flava*, *Cuphea flavisetula*, *Cuphea fuchsiifolia*, *Cuphea gaumeri*, *Cuphea glutinosa*, *Cuphea heterophylla*, *Cuphea hookeriana*, *Cuphea hyssopifolia* (Mexican-heather), *Cuphea hyssopoides*, *Cuphea ignea*, *Cuphea ingrata*, *Cuphea jorullensis*, *Cuphea lanceolata*, *Cuphea linarioides*, *Cuphea Ilavea*, *Cuphea lophostoma*, *Cuphea lutea*, *Cuphea lutescens*, *Cuphea melanium*, *Cuphea melvilla*, *Cuphea micrantha*, *Cuphea micropetala*, *Cuphea mimuloides*, *Cuphea nitidula*, *Cuphea palustris*, *Cuphea parsonsia*, *Cuphea pascuorum*, *Cuphea paucipetala*, *Cuphea procumbens*, *Cuphea pseudosilene*, *Cuphea pseudovaccinium*, *Cuphea pulchra*, *Cuphea racemosa*, *Cuphea repens*, *Cuphea salicifolia*, *Cuphea salvadorensis*, *Cuphea schumannii*, *Cuphea sessiliflora*, *Cuphea sessilifolia*, *Cuphea setosa*, *Cuphea spectabilis*, *Cuphea spermacoce*, *Cuphea splendida*, *Cuphea splendida* var. *viridiflava*, *Cuphea strigulosa*, *Cuphea subuligera*, *Cuphea teleandra*, *Cuphea thymoides*, *Cuphea tolucana*, *Cuphea urens*, *Cuphea utriculosa*, *Cuphea viscosissima*, *Cuphea watsoniana*, *Cuphea wrightii*, *Cuphea lanceolata*).

In some embodiments, host organisms, or modified organisms, can be hydrocarbon-utilizing (e.g. alkane-utilizing), fatty acid-utilizing and/or fatty alcohol-utilizing microorganisms. These organisms are able to assimilate hydrocarbons, fatty acids and/or fatty alcohols for energy and biomass generation. Many of these organisms are able to utilize hydrocarbons, fatty acids and/or fatty alcohols as a sole carbon source. Some examples of hydrocarbon-, fatty acid- and/or fatty alcohol-utilizing microorganisms include some species of fungi (including, e.g., yeast), bacteria and algae.

Non-limiting examples of such organisms include *Yarrowia* (e.g., *Y. lipolytica* (formerly classified as *Candida lipolytica*)), *Candida* (e.g., *C. apicola*, *C. maltosa*, *C. tropicalis*, *C. utilis*, *C. viswanathii*, *C. catenulate*, *C. rugose*, *C. vini*, *C. entamophila*, *C. intermedia*), *Aspergillus* (e.g., *A. niger*, *A. versicolor*, *A. ustus*, *A. fumigatus*, *A. oryzae*, *A. flavus*, *A. ficuum*, *A. terricola*, *A. japonicas*, *A. wentii*, *A. clavatus*, *A. terreus*), *Penicillium* (*P. cyclopium*, *P. chrysogenum*, *P. italicum*), *Fusarium* (e.g., *F. oxysporum*, *F. moniliforme*, *F. solani*), *Paecilomyces* (e.g., *Paec. lilacinus*), *Trichoderma* (e.g., *T. koningii*, *T. viride*, *T. virens*), *Cladosporium* (e.g., *C. herbarum*), *Stachybotrys*, *Trichosporon* (e.g., *T. veenhuisii*, *T. asahii*, *T. jirovecii*, *T. monteviblankiideense*), *Rhodotorula* (e.g., *R. glutinous*, *R. mucilaginosa*), *Rhodosporidium* (e.g., *R. toruloides*), *Cryptococcus* (e.g., *C. neoformans*, *C. albidus*), *Pichia* (e.g., *P. farinosa*, *P. stipitis*), *Debaryomyces* (e.g., *D. hansenii*), *Blastobotrys* (e.g., *Blastobotrys adeninivorans*), *Saccharomyces* (e.g., *S. cerevisiae*, *S. bayanus*, *S. pastorianus*, *S. carlsbergensis*), *Lipomyces* (e.g., *L. starkeyii*, *L. lipoferus*) and *Chlorella* algae (e.g., *Chlorella protothecoides*).

In some embodiments, a host organism or modified organism can be an oleaginous organism (e.g., an oleaginous microorganism). As used herein, an "oleaginous" organism is an organism capable of accumulating at least about 20% or more of its cell mass (by dry weight) as intracellular lipids (e.g., oil). In oleaginous organisms, a significant carbon flux towards lipid synthesis occurs and is enhanced under certain conditions (e.g., limited supply of nitrogen). These lipid-accumulating organisms can be characterized by the endogenous expression of cytosolic ATP citrate lyase, which catalyzes the degradation of citrate generated in the TCA cycle into acetyl-CoA and oxaloacetate, and/or a dependence on AMP concentration for the activity of isocitrate dehydrogenase in the TCA cycle. Generally, under certain conditions (e.g., limited nitrogen), AMP deaminase is activated in oleaginous yeast which can lead to a decrease in mitochondrial AMP concentration and isocitrate dehydrogenase activity. This, in turn, can cause an accumulation of mitochondrial citrate from the TCA cycle which is then exported to the cytosol and can serve as substrate for ATP citrate lyase. The acetyl-CoA that may be generated through the action of ATP citrate lyase can be used in synthesizing fatty acyl-CoA that can be converted into lipids which may be stored in lipid bodies in the cells. A "non-oleaginous" organism, as used herein, is an organism that is not capable of accumulating at least about 20% or more of its cell mass (by dry weight) as intracellular lipids. In some embodiments, a host organism or modified organism can be a non-oleaginous organism.

Oleaginous microorganisms include species of fungi, bacteria and algae. Examples of oleaginous fungi include, but are not limited to, *Blastobotrys* (e.g., *Blastobotrys adeninivorans*), *Yarrowia* (e.g., *Y. lipolytica*), *Trichosporon* (e.g., *T. fermentans*, *T. porosum*, *T. pullulan*), *Rhodotorula* (e.g., *R. graminis*, *R. glutinous*, *R. araucariae*, *R. minuta*, *R. bogoriensis*, *R. mucilaginosa*, *R. colostri*), *Rhodosporidium* (e.g., *R. toruloides*, *R. kractochvilovae*, *R. paludigenum*, *R. fluviale*, *R. babjevae*), *Lipomyces* (e.g., *L. starkeyii*, *L. lipofer*), *Debaryomyces* (e.g., *D. hansenii*), *Cryptococcus* (e.g., *C. podzolicus*, *C. phenolicus*, *C. curvatus*), *Pichia* (e.g., *P. segobiensis*), *Cystofilobasidium* (e.g., *C. informiminiatum*), *Leucosporidium* (e.g., *L. scottii*), *Sporobolomyces* (e.g., *S. singularis*, *S. poonsookiae*, *S. odoratus*, *S. metaroseus*, *S. bannaenis*), *Sporidiobolus* (e.g., *S. ruineniae*, *S. carnicolor*, *S. pararoseus*, *S. johnsonii*), *Schwanniomyces* (e.g., *S. occidentalis*), *Occultifur* (e.g., *O. externus*), *Blakeslea*, *Cunninghamella, *Mortirella, Mucor, Phycomyces* and *Pythium*. Non-limiting examples of oleaginous bacteria include *Morrococcus, Bacillus subtilis* and *Rhodococcus opacus*. Examples of oleaginous algae include, but are not limited to *Nannochloropsis* (e.g., *N. oceania*), *Chlorella* (e.g., *C. vulgaris*), *Thraustochyrtium* and *Schizochytrium*.

In particular embodiments, a host organism or modified organism can be a non-oleaginous yeast. In some embodiments, a host organism or modified organism can be a non-oleaginous, non-*Saccharomyces* yeast. Included among such yeast are non-oleaginous, non-*Saccharomyces* ascomycetes yeast as well as non-oleaginous, basidiomycetes yeast and non-oleaginous, ascomycetes yeast. In certain aspects, a host organism or modified organism can be an oleaginous, non-*Yarrowia* yeast, a non-*Yarrowia* ascomycetes yeast, or a non-*Yarrowia*, non-*Saccharomyces*, ascomycetes yeast. In another aspect, a host organism or modified organism can be an oleaginous yeast that accumulates 20% to 65% or 20% to 60% or 20% to 58%, or 20% to 55%, or 20% to 50% or 20% to 45%, or 20% to 40% or 20% to 35%, or 20% to 30% or 20% to 25% of its cell mass (by dry weight) as intracellular lipids (e.g., oil). In another embodiment, a host organism or modified organism can be an oleaginous yeast that accumulates at least 20% or at least about 25% of its cell mass (by dry weight) as intracellular lipids (e.g., oil). In a further embodiment, a host organism or modified organism can be an oleaginous yeast that accumulates at least 20% but less than 70%, or at least 20% but less than 60%, or at least 20% but less than 50%, or at least 20% but less than 40%, or at least 20% but less than 30%, of its cell mass (by dry weight) as intracellular lipids (e.g., oil). In another embodiment, a host organism or modified organism can be an oleaginous yeast in which linoleic acid is less than 50% or less than 45% or less than 40% or less than 35% or less than 30% or less than 25% or less than 20% of the intracellular accumulated lipid composition.

In some embodiments, a host cell or organism or modified cell or organism is one that is capable of ω-oxidation of alkanes and/or fatty acids. Such cells or organisms can endogenously produce enzymes of the ω-oxidation pathway. This pathway includes steps of w-hydroxylation, oxidation and dehydrogenation of ω-carbon. The ω-hydroxylation step can be catalyzed by a hydroxylase complex including a cytochrome P450 monooxygenase (such as, for example, an alkane-inducible cytochrome P450, e.g., CYP52) and a cytochrome P450:NADPH oxidoreductase which yields an alcohol. In a subsequent oxidation step, the alcohol is further oxidized to an aldehyde in a reaction catalyzed by a fatty alcohol oxidase. A dicarboxylic acid is generated through dehydrogenation of the aldehyde by a fatty aldehyde dehydrogenase. In some aspects, a host cell or organism endogenously expresses proteins having cytochrome P450 monooxygenase and cytochrome P450:NADPH oxidoreductase activity. In some embodiments, a host cell or organism or modified cell or organism is one that is capable of synthesizing dicarboxylic acids, such as, for example, α,ω-dicarboxylic acids.

In some embodiments, the host cell or organism or modified cell or organism is a diploid cell or organism. In certain aspects, the host cell or organism or modified cell or organism is an anamorphic ascomycetes yeast.

In some embodiments, a host organism or modified organism can be a thermotolerant and/or osmotolerant organism. As used herein, "thermotolerant," in reference to an organism, e.g., a microorganism, refers to the ability of the organism to survive at elevated temperatures. For example, a thermotolerant organism, e.g., a microorganism, such as a yeast, is one that is able to survive and/or grow and/or assimilate fatty acids and/or aliphatic carbon sources at temperatures greater than 30° C., greater than 31° C., greater than 32° C., greater than 33° C., greater than 34° C., greater than 35° C., greater than 36° C., greater than 37° C., greater than 38° C., greater than 39° C., greater than 40° C., greater than 41° C., greater than 42° C., greater than 43° C., greater than 44° C., greater than 45° C., greater than 46° C., greater than 47° C., or greater than 48° C. A thermotolerant organism can be one that is able to survive and/or grow and/or assimilate fatty acids and/or aliphatic carbon sources at temperatures up to about 30° C., 32° C., 34° C., 35° C., 40° C., 41° C., 42° C., 43° C., 44° C., 45° C., 46° C., 47° C., 48° C., 49° C. or 50° C. or more. As used herein, "osmotolerant," in reference to an organism, e.g., a microorganism, refers to the ability of the organism to survive in elevated external osmotic pressure environments, e.g., high solute (such as salt or sugar) concentrations). For example, an osmotolerant organism, e.g., a microorganism, such as yeast, is one that is able to survive and/or grow and/or assimilate fatty acids and/or aliphatic carbon sources in media containing up to about 15%, 16%, 17%, 18%, 19%, 20%, 21%, 22%, 23%, 24%, 25% or greater NaCl. Thermotolerant and/or osmotolerant microorganisms include, for example, species of *Blastobotrys* yeast (e.g., *Blastobotrys adeninivorans*), *Candida* yeast (e.g., *C. Mexicana, C. glycerinogenes, C. zemplinina*), *Pichia* yeast (e.g., *P. mississippiensis, P. mexicana, P. farinosa, P. sorbitophila*), *Clavispora* yeast (e.g., *C. opuntiae, C. lusitaniae*), *Kluyveromyces* yeast (e.g., *K. thermotolerans*), *Debaryomyces* (e.g., *D. hansenii*), *Rhodotorula* (e.g., *R. mucilaginosa*), *Zygosaccharomyces* (e.g., *Z. rouxii*) and *Issatchenkia* (e.g., *I. orientalis*). Thermotolerant and/or osmotolerant organisms can be well suited for use in industrial production systems operating at elevated temperatures and/or osmotic pressures that would impair growth and/or metabolism and/or completely inactivate organisms that are not thermotolerant and/or osmotolerant. Furthermore, in many instances, production efficiency can be improved and production costs reduced in using such organisms due to decreases in losses and avoidance of implementation of cooling processes.

Host cells and microorganisms and engineered cells and microorganisms may be provided in any suitable form. For example, such cells and microorganisms may be provided in liquid culture or solid culture (e.g., agar-based medium), which may be a primary culture or may have been passaged (e.g., diluted and cultured) one or more times. Microorganisms and cells also may be provided in frozen form or dry form (e.g., lyophilized). Microorganisms and cells may be provided at any suitable concentration.

Modified Cells and Organisms

Provided herein are cells and organisms (including microorgansims) that have been modified in one or more aspects relative to the unmodified cell or organism (i.e., the cell or organism prior to the modification). For example, a cell or organism can be modified by altering one or more cellular activities and/or the sum total of a cell's or organism's activities. Thus, in this example, modifications can include alteration of cellular activities, addition of cellular activities and/or elimination of cellular activities. A "cellular activity," as used herein, refers to any process, functioning, or operation that can occur in a cell. In particular embodiments provided herein, a cell or organism has been modified to alter cellular carbon flux. Such modified cells and organisms have been manipulated in ways designed to direct carbon atoms toward one or more biochemical events, cellular activities or cellular locations and/or away from other metabolic pathways, cellular activities or locations. The alteration(s) can involve a single modification or multiple modifications of the original, or host, cell or organism in which carbon flux is altered. Also provided herein are methods of producing such modified cells and organisms. As described herein, there are multiple methods of altering cellular carbon flux by modifying one or more aspects of carbon processing in cells. Aspects of cellular carbon processing include, for example, but are not limited to, fatty acid metabolism, including fatty acid catabolism and synthesis, ω-oxidation, β-oxidation, fatty acid transport, acetyl group transfer/transport and processing, the TCA cycle, metabolite processing and triacylglyceride and lipid biosynthesis. For example, in altering carbon flux, certain cellular activities may be reduced, slowed or eliminated and/or other activities may be increased, accelerated, added or relocated. In particular embodiments, the amount and/or activity of one or more enzymes and/or transport proteins is/are modified in cells or microorganisms.

As such, the cells and organisms provided herein are "modified" or "engineered." The terms "engineered" or "modified," as used interchangeably herein, in reference to a cell, organism or microorganism refer to a cell or organism (including a microorganism) that has been manipulated or altered such that it is distinct (e.g., detectably changed or physically different) from a naturally occurring cell or organism. For example, the sum total of the cellular activities of a modified or engineered cell or microorganism can be distinct from those of a naturally occurring cell or microorganism, e.g., a modified cell or microorganism may include or lack one or more activities relative to the activities present in an unmodified cell or microorganism utilized as a starting point (e.g., host cell, host organism or host microorganism) for modification. In another example, one or more cellular activities of a modified or engineered cell or microorganism may be altered relative to the cellular activity or activities of the host cell or microorganism. A modified or engineered cell or organism can be genetically modified through any alteration in its genetic composition. For example, a genetically modified cell or organism can include one or more heterologous polynucleotides, can have one or more endogenous nucleic acid deletions and/or can have one or more genetic mutations. Mutations include point mutations, insertions and deletions of a single or multiple residues in a nucleic acid. In some embodiments, an engineered cell, organism or microorganism includes a heterologous polynucleotide, and in certain embodiments, an engineered cell, organism or microorganism has been subjected to selective conditions that alter an activity, or introduce an activity, relative to the host cell or microorganism. Thus, a modified or engineered cell, organism or microorganism has been altered directly or indirectly by a human being. It is understood that the terms "modified cell," "modified organism," "modified microorganism," "engineered cell," "engineered organism," "engineered microorganism," refer not only to the particular cell or organism but to the progeny or potential progeny of such a cell or organism. Because certain modifications may occur in succeeding generations due to either mutation or environmental influences, such progeny may not, in fact, be identical to the parent cell, but are still included within the scope of the term as used herein.

For example, a "genetically modified" or "genetically engineered" cell, organism or microorganism is one in which the genetic make-up of the cell, organism or microorganism has been modified. Genetic modification encompasses a variety of alterations and can be accomplished in numerous ways. A genetic modification includes, but is not limited to, any of the following alterations: modification of the expression of an endogenous gene (e.g., the amount, pattern, timing and/or regulation (e.g., inducibility) of expression of a gene), disruption or deletion of an endogenous gene, increasing the copy number of an endogenous gene, mutation of an endogenous gene (including the regulatory components, exons, introns and/or peptide- or protein-encoding portions of a gene), and introduction of heterologous nucleic acid in to a cell or cells. These genetic modifications, and others, are described herein.

A genetic modification of a cell or organism can be one that modifies the expression of one or more nucleic acids or polypeptides in the cell or organism. A genetic modification of a cell or organism can be one that modifies the amount and/or activity of a polypeptide in the cell or organism. For example, modified expression of a nucleic acid or protein (e.g., modified rate, amount and/or level of expression) or modified amount or activity of a polypeptide may be a reduction, slowing, decrease or elimination, or increase, acceleration, addition or elevation in expression of a nucleic acid or protein or in the amount and/or activity of a polypeptide.

Modified expression of a nucleic acid or modification of the amount and/or activity of a polypeptide may be a relocation of expression or activity within a cell.

In one example, a genetic modification of a cell or organism can be one that alters the expression of, or the amount and/or activity of, a polypeptide involved in a reaction that generates a product (e.g., cytosolic acetyl-CoA, cytosolic malonyl-CoA, peroxisomal acetate) in a cell or organism. A "polypeptide involved in a reaction that generates," as used herein with respect to generation of a product, refers to a polypeptide that participates in the direct generation of the product from reactants. A reaction that directly generates a particular product can be a single-step reaction or a multi-step reaction involving transient reaction intermediates. For example, a polypeptide involved in a reaction that generates cytosolic acetyl-CoA is one that participates in a reaction that directly yields acetyl-CoA in the cytosol. Exemplary polypeptides (e.g., enzymes) involved in a reaction that generates cytosolic acetyl-CoA include, but are not limited to, cytosolic carnitine acetyltransferase, cytosolic acetyl-CoA synthetase and cytosolic ATP citrate lyase. A polypeptide involved in a reaction that generates cytosolic malonyl-CoA is one that participates in a reaction that directly yields malonyl-CoA in the cytosol. A non-limiting example of a polypeptide involved in a reaction that generates cytosolic malonyl-CoA is acetyl-CoA carboxylase. A polypeptide involved in a reaction that generates peroxisomal acetate is one that participates in a reaction that directly yields acetate in the peroxisome. A non-limiting example of a polypeptide involved in a reaction that generates peroxisomal acetate is acetyl-CoA hydrolase.

The term "endogenous," as used herein in reference to an aspect (e.g., a gene, nucleic acid, peptide, polypeptide, activity, genetic composition, gene expression, and the like) of a cell or organism or microorganism refers to the inherent aspect, or condition thereof, in the cell, organism or microorganism that has not been modified or engineered (i.e., the reference cell, organism or microorganism). The term "heterologous," "exogenous" or "foreign" as used herein with respect to a composition or quality (e.g., a gene, nucleic acid, peptide, polypeptide, cellular activity, genetic composition, gene expression, and the like) refers to the composition or quality not being a physically existing part or attribute of a reference cell, organism or microorganism. For example, a heterologous, exogenous or foreign nucleic acid can be any nucleic acid that is introduced into a cell or microorganism as part of a genetic modification of the cell or microorganism. A heterologous, exogenous or foreign composition (such as, for example, a nucleic acid) includes compositions that may be identical to an endogenous composition (e.g., a nucleic acid gene sequence that is introduced into a cell or microorganism to increase the copy number and/or alter the positioning or expression of the same nucleic acid sequence existing therein) or may be different from an endogenous composition.

Coordination of Carbon Source, Host Organism and Regulatory Mechanisms to Optimize Carbon Flux Modification In developing cell- and organism-based systems for enhanced production of target molecules, there are multiple factors, in addition to the design of cellular modifications for altering carbon flux, that can affect the overall efficiency and economics of the production process. These additional considerations include the sources of carbon available to the microorganism, the organism's ability to utilize various forms of carbon in the sources and the cellular regulatory systems that can be used in controlling carbon flux. Coordination of these factors can play a significant role in optimization of carbon flux alteration and, in turn, the efficiency of target molecule production.

Carbon sources used for culturing cells and microorganisms and/or fermentation processes sometimes are referred to as feedstocks. The term "feedstock" as used herein refers to a composition containing a carbon source that is provided to a cell or organism, which is used by the cell or organism to produce energy and metabolic products useful for growth. In order for cells and organisms to utilize carbon in vital processes, the carbon source is processed intracellularly in catabolic pathways to a form(s) that can be accommodated by energy generation and biosynthetic pathways. For example, glucose is processed in glycolytic pathways in cells whereas fatty acids are processed through β-oxidation. Thus, the carbon source used in microbial-based methods of target molecule production can influence which metabolic pathways will be involved in assimilating the carbon. A target molecule production system that incorporates elements of endogenous cellular metabolic pathways may not perform optimally if those pathways are not utilized in processing the carbon source.

Some cells and microorganisms are able to utilize a variety of carbon sources. However, many cells and microorganisms preferentially utilize particular carbon sources over others, and some cells and microorganisms are unable to utilize certain carbon sources. For example, *Saccharomyces cerevisiae* can utilize xylulose but not xylose. *Blastobotrys adeninivorans* and *Arxula terestre* are able to utilize carbon- and nitrogen-containing compounds, e.g., adenine, uric acid, butylamine and pentylamine, as a sole source of carbon and nitrogen.

One consideration in the design of an economically feasible cell-based system for the production of target molecules is production-associated costs. The carbon source used in cultivating cells and organisms can be a significant factor contributing to production costs. Many microorganisms, including yeast, preferentially use glucose over other carbon sources. However, glucose is a relatively high-cost carbon source. Therefore, from an economic perspective, it can be beneficial to utilize lower-cost sources of carbon in bioproduction systems. Non-fermentable carbon sources, including, for example, glycerol and fatty acids, may be lower-cost alternatives to glucose and other carbohydrates in feedstocks. For example, waste materials, such as waste cooking oil, can be used as feedstocks containing non-fermentable carbon sources.

Therefore, in developing a cost-effective, efficient cell- or microbial-based target molecule production system, the modifications made to an organism to alter carbon flux should be coordinated and compatible with, and complementary to, the carbon source and cell or organism that will be employed in the production methods. Additionally, for optimal target molecule production, the regulatory mechanisms that are used in the cell or organism for controlling the individual elements (e.g., enzyme expression) being modified should provide for timing and extent of each element's activity that correlates with the desired carbon flux alterations at each stage of the production process.

For example, some embodiments of the cell- and microbial-based methods for producing target molecules provided herein include cells or organisms in which carbon processing activities have been engineered to enhance carbon flow through cellular oxidative metabolism pathways, e.g, ω-oxidation and/or β-oxidation. One advantage of such modified bioproduction systems is that they are well suited for use with lower cost, alternative carbon sources, including, for example, non-carbohydrate and non-fermentable carbon sources such as aliphatic compounds and hydrocarbons (e.g., alkanes, fatty acids and fatty alcohols). Use of such carbon sources is not only more cost-effective but can also have the added advantage of reducing the environmental impact of harmful wastes (e.g., agro-industrial by-products, waste cooking oil and waste motor oil) that can be used as feedstocks in target molecule production instead of being discarded. Cells or organisms particularly compatible with such methods are those that are able to utilize non-fermentable, as well as fermentable, carbon sources. Generally, such cells and organisms contain endogenous metabolic pathways that form part of the basis for the desired carbon flux modifications. As also described herein, embodiments of the cell- and microbial-based systems in which carbon processing activities have been engineered to direct carbon flow through oxidative metabolism and away from mitochondrial metabolism can be controlled to provide for maximal, coordinated and highly efficient target molecule production based on, for example, use of carbon source-dependent transcription regulation of modified activities in the cells.

Transcription regulatory elements, including promoters, for some genes are responsive to the carbon source available to the cells. For example, transcription of some genes is subject to glucose repression in which the gene may not be expressed, or is less expressed, in the presence of glucose. Thus, in contrast to unregulated constitutive promoters, transcription regulatory elements for genes such as these are repressed, derepressible and/or inducible by varying carbon sources. When glucose is depleted, genes that were subject to glucose repression are then transcribed in a process referred to as glucose derepression. For some of these genes, this increase in transcription due to derepression represents the extent to which the genes will be expressed because they are not subject to induction and further increased transcription. For others of these genes, transcription may be increased several-fold over the derepressed level upon induction by, for example, certain carbon sources. Examples of such carbon sources include, but are not limited to, vegetable oils, triglycerides, fatty acids, e.g. oleic acid, esters of fatty acids and n-alkanes. Some genes encoding peroxisomal proteins (including enzymes involved in fatty acid catabolism) are subject to glucose repression/derepression. As described herein, the transcription regulatory elements for genes subject to glucose repression can advantageously be used in cell- and microbial-based methods for target molecule production involving alternative carbon sources.

Different carbon sources or feedstocks may be used in culturing cells or microorganisms at different phases of a target molecule production process. For example, one carbon source, e.g., glucose, may be used in preparing an initial starter culture of modified cells or microorganisms to establish a foundation of growing cells and a different carbon source (e.g., a lower-cost alternative such as fatty acids) may be used in a target molecule production phase subsequent to establishment of the starter culture. Accordingly, carbon source utilization can vary depending on the goal of a particular time or phase of a culture process.

In some embodiments of cell- and microbial-based target molecule production systems provided herein, modifications made to the cells or microorganisms include use of carbon source-dependent regulatory elements in altering carbon flux to enhance production efficiency. As described herein, in some embodiments, cytosolic activities for generating acetyl-CoA and/or malonyl-CoA (e.g., carnitine acetyltransferase, acetyl-CoA carboxylase, acetyl-CoA synthetase and/or ATP citrate lyase) can be increased for target molecule production during fatty acid or alkane assimilation, while mitochondrial and/or cytosolic activities for uptake and utilization of acetyl group carbons (e.g., cytosolic acyl-CoA synthetase, mitochondrial acetyl-carnitine transporters and/or mitochondrial carnitine acetyltransferase) are decreased. For optimal coordination of these activities with the overall production process, in some embodiments, the expression of proteins involved in some of the target molecule production activities can be engineered to be controlled by particular glucose-repressible and/or fatty acid-inducible transcription regulatory elements. For example, during initial cell-growth stages of a production method, a preferred carbon source may be, for example, glucose. Activities participating in target molecule production can be suppressed during this stage by using glucose-repressible elements, e.g., promoters, to regulate transcription of nucleic acids encoding proteins involved in those activities. At the same time, activities (e.g., mitochondrial metabolism) involved in cellular energy generation for growth can be permitted to function and/or elevated by using constitutive or glucose-inducible elements, e.g., promoters, to regulate transcription of nucleic acids encoding proteins involved in those activities. On the other hand, activities participating in target molecule production will be permitted and/or increased following growth stages and during target molecule production stages when glucose is depleted and fatty acid carbon sources are provided by using glucose-repressible and/or fatty acid-inducible elements, e.g., promoters, to regulate transcription of nucleic acids encoding proteins involved in those activities. Also during those stages, the activities (e.g., mitochondrial metabolism) involved in cellular energy generation and growth can be unchanged or reduced or minimized by using weak, constitutive and/or glucose-inducible/fatty acid-inhibited elements, e.g., promoters, to regulate transcription of nucleic acids encoding proteins involved in those activities. This type of coordination of gene expression regulation with cellular modifications to alter carbon flux and use of alternative carbon sources can greatly enhance target molecule production efficiency and economy.

In some embodiments of cell- and microbial-based target molecule production systems provided herein, such as those in which target molecule production involves cellular oxidative metabolism pathways, e.g, ω-oxidation and/or β-oxidation, for processing of fatty acids and/or alkanes, modifications made to the cells or microorganisms may include optimization of carbon source-dependent regulatory elements within the pathways. For example, although expression of unmodified genes encoding some of the polypeptides (e.g., enzymes) in these pathways is regulated by glucose-repressible and/or fatty acid (and/or alkane)-inducible transcriptional control elements, it may be beneficial to utilize heterologous stronger, more active, fatty acid (and/or alkane)-inducible transcriptional control elements to increase expression and/or activity of pathway polypeptides (e.g., enzymes) in modified cells and organisms. Thus, for example, the promoter of an endogenous glucose-repressible and/or fatty acid-inducible gene (e.g., an acyl-CoA oxidase (such as Pox5p), a peroxisomal protein (such as Pex11p), a cytochrome P450 monooxygenase or reductase (such as CYP52A17 or CPRB proteins)) can be replaced with a glucose-repressible and/or fatty acid-inducible promoter from another gene (e.g., an HDE gene) to enhance carbon processing through oxidative metabolism in modified cells or organisms.

In some embodiments of cell- and microbial-based target molecule production systems provided herein, carbon flux can be altered to reduce acetyl carbon processing in mitochondria during target molecule production occurring with fatty acid or alkane assimilation. In these embodiments, transcriptional control elements of some endogenous glucose-repressible and/or fatty acid-inducible genes encoding mitochondria-associated polypeptides (e.g., mitochondrial transporter proteins (such as Crc1p) and carnitine acetyltransferases (such as Cat2p)) can be replaced with a promoter that is not fatty acid-inducible (e.g., a weaker and/or constitutive promoter) from another gene (e.g., glucose-6-phosphate isomerase gene) to reduce acetyl carbon uptake by and/or metabolism in mitochondria in modified cells or organisms. As also described herein, acetyl carbon uptake by and/or metabolism in mitochondria can be reduced in modified cells and organisms by replacing genes encoding one or more endogenous mitochondria-associated polypeptides (e.g., enzymes, such as carnitine acetyltransferase) with nucleic acid encoding a less active polypeptide. The nucleic acid encoding a less active polypeptide may also be linked to a transcriptional control element that provides for weak and/or not inducible expression of the polypeptide. If, however, the activity of the less-active polypeptide is insufficient for optimal cell functioning, a more active, inducible (e.g., fatty acid-inducible) promoter can be used to regulate expression of the less-active polypeptide.

Aliphatic and Hydrophobic Carbon Sources

The ability of cells and microorganisms to utilize alternative carbon sources for energy generation and growth is based in the multiple enzyme-mediated metabolic pathways and gene regulation systems in microbial cells. In general, glucose often is a preferred carbon and energy source for many cells and microorganisms, e.g., yeast. A number of genes encoding products, such as certain enzymes, involved in cellular pathways and processes that are not used in carbohydrate metabolism may be repressed when glucose is present in culture media. If glucose is depleted in the media, some of these genes may then be derepressed. If alternative carbon sources, e.g., non-fermentable carbon sources, are available, some of the genes may be induced, and may be induced by several-fold. For example, when aliphatic or hydrophobic carbon sources, (e.g., alkanes, alkenes, fatty acids) are the external carbon source, the expression of genes encoding enzymes involved in β-oxidation and proteins involved in peroxisome proliferation can be induced.

One example of a gene that is repressed in glucose media, derepressed in non-fermentable carbon source-containing media and induced in fatty acid-containing media is the gene encoding the peroxisomal trifunctional enzyme hydratase-dehydrogenase-epimerase (HDE) in yeast, such as, for example, *Candida* (see, e.g., Sloots et al. (1991) *Gene* 105:129-134). The upstream regulatory regions of the HDE gene include a glucose-responsive region controlling glucose repression, a non-fermentable carbon-responsive region controlling derepression and an oleic acid-responsive region controlling fatty acid induction of transcription of the gene.

In some embodiments of the methods for producing a target molecule provided herein, a carbon source used during the production phase of a culturing step in the method includes an aliphatic or hydrophobic carbon source. In particular embodiments, an aliphatic or hydrophobic carbon source is the primary carbon source or may be the sole, or only, carbon source used during the production phase of a culturing step in the method. In some embodiments, the carbon source is a fatty acid and/or alkane. In certain aspects, the carbon source is a fatty acid. In some embodiments, the carbon source is an 18-carbon fatty acid such as, for example, oleic acid (C18:1), linoleic acid (C18:2) or linolenic acid (C18:3). Embodiments of the methods in which an aliphatic or hydrophobic carbon source is used are particularly advantageous when target molecule production involves oxidation pathways such as ω-oxidation and/or β-oxidation pathways and/or involves peroxisomes.

Additional advantages of using aliphatic or hydrophobic carbon sources in some embodiments of the methods of producing target molecules as provided herein are reduced costs and positive environmental effects realized through their use.

Methods of Modifying Cellular Carbon Flux

Included in the cells, organisms and microorganisms and methods described herein are those that provide for enhanced production of desired target molecules. In one aspect, production is enhanced through modification of carbon flux in cell or microbial production systems. Through modification of cellular carbon flux, carbon atoms that may have flowed or been transported into other metabolic processes (e.g., energy and/or cellular composition generation) in the cell are redirected for use in a target molecule production process. Described herein are multiple cellular modifications that can be employed to beneficially alter carbon flux. A modification can be used alone or in combination with one or more other modifications depending on the target molecule produced and the carbon flux alteration that is best suited to maximize its production.

Modification of Acetyl-Carnitine Entry into Mitochondria

Included in embodiments of the cells, microorganisms, compositions and methods provided herein are cell and microbial production platform systems and components thereof in which the amount of (a) acetyl-carnitine in the cell cytosol and/or (b) carnitine acetyltransferase and/or carnitine acetyltransferase activity in the cell cytosol is/are modified. Carnitine and carnitine acetyltransferase are the primary elements of the carnitine shuttle system in which acetyl carbons from acetyl-CoA are transferred across intracellular membranes and transported throughout eukaryotic cells. For example, the carnitine shuttle is a mechanism through which acetyl carbons from acetyl-CoA generated in peroxisomes flow to mitochondria. Acetyl groups from peroxisomal acetyl-CoA can be transferred to carnitine in a reaction catalyzed by carnitine acetyltransferase and then move across the peroxisomal membrane and into the cytosol in the form of acetyl-carnitine. Cytosolic acetyl-carnitine can then be transported into mitochondria where mitochondrial carnitine acetyltransferase catalyzes the reverse reaction to transfer the acetyl moiety from carnitine to free coenzyme A to generate acetyl-CoA. The carnitine shuttle provides a main "highway" for the flow of carbon atoms into mitochondria, particularly in the assimilation of fatty acids and other non-carbohydrate and non-fermentable carbon source molecules by cells. It is thus one target for modification of carbon flux in cells and microorganisms provided herein.

In some embodiments of the cells, microorganisms, compositions and methods provided herein, the amount of (a) acetyl-carnitine in the cell cytosol is increased and/or decreased, and/or (b) carnitine acetyltransferase and/or carnitine acetyltransferase activity in the cell cytosol is/are increased and/or decreased. For example, in some aspects, a cell or microorganism may be modified to increase cytosolic acetyl-carnitine, may be modified to decrease cytosolic acetyl-carnitine or may be modified to alternately increase and decrease cytosolic acetyl-carnitine depending on the conditions in which the modified cell or microorganism is cultured.

In certain embodiments, a host cell or microorganism is modified to increase the amount of (a) acetyl-carnitine in the cell cytosol and/or (b) carnitine acetyltransferase and/or carnitine acetyltransferase activity in the cell cytosol. Increasing the amount and/or activity of cytosolic carnitine acetyltransferase provides for an increased conversion of acetyl-carnitine into acetyl-CoA in the cytosol. Increasing the amount of acetyl-carnitine in the cytosol provides an increased availability of substrate for cytosolic carnitine acetyltransferase to convert to acetyl-CoA. These modifications effectively result in an increase in the generation and amount of cytosolic acetyl-CoA which can then be used in the production of desired carbon-containing molecules.

Modification of a Mitochondrial Acetyl-Carnitine Transporter

In one embodiment, cells or organisms provided herein are modified to increase and/or decrease the amount of acetyl group carbons in the cytosol in the form of acetyl-carnitine in transit from the peroxisome and other areas to the mitochondria by increasing or reducing the entry of acetyl-carnitine into mitochondria from the cytosol. In one aspect, the amount and/or rate of acetyl-carnitine transfer into the mitochondria in a cell can be increased or reduced by increasing or decreasing the expression of an acetyl-carnitine translocase protein localized in mitochondrial inner membranes. This protein carrier transports acetyl-carnitine across the mitochondrial inner membrane and into the mitochondrial matrix in exchange for carnitine. For example, a mitochondrial carnitine translocase is encoded by a CRC1 gene in *Saccharomyces* (see, e.g, Palmieri et al. (1999) *FEBS Lett* 462:472-276), which contains an oleate-responsive element in the promoter region, and by an AcuH gene in *Asperillgus* (see, e.g., De Lucas et al. (2001) *FEMS Microbiol Lett* 201:193-198). Carnitine carrier proteins belong to a family of mitochondrial carrier proteins which generally contain three tandemly repeated ~100-amino acid domains. Each of the three domains typically contains two hydrophobic regions, spanning the membrane as α-helices, linked by a hydrophobic loop that extends into the mitochondrial matrix. Each domain also typically contains a version of a motif (PX[DE]XX[RK]XRK) involved in forming a salt bridge that closes off the matrix side of a channel generated by the α-helices (see, e.g., Indiveri et al. (2011) *Molecular Aspects of Medicine* 32:223-233).

There are a number of ways to increase or reduce expression of an acetyl-carnitine translocase in a cell. For example, a host acetyl-carnitine translocase activity can be decreased by disruption (e.g., knockout, insertion mutagenesis, the like and combinations thereof) of a host gene encoding the protein, or by decreasing the activity of the promoter (e.g., through addition of repressor sequences to the promoter or 5'UTR or replacing the promoter) that controls transcription of an acetyl-carnitine translocase gene using recombinant molecular biology techniques known in the art and/or described herein. One method for disrupting an endogenous acetyl-carnitine translocase gene is by recombinantly inserting a heterologous nucleic acid (e.g., a nucleotide sequence encoding a selectable marker such as an enzyme that restores an auxotrophic host cell or organism to prototrophy) into the endogenous gene, thereby generating an engineered cell or organism deficient in acetyl-carnitine translocase activity. This can be done, for example, through homologous recombination in which a heterologous nucleic acid containing sequences of the endogenous acetyl-carnitine translocase gene and a disrupting sequence (e.g., a knock-out gene cassette such as described herein) is introduced into a host cell or microorganism. Nucleic acids encoding an acetyl-carnitine translocase can be obtained from a number of sources, including, for example, yeast cells. For example, genomic DNA from cell sources can be amplified using oligonucleotide primers based on the nucleotide sequence of an acetyl-carnitine translocase-encoding gene. Provided herein, for example, are a nucleotide sequence (SEQ ID NO: 71) that encodes a *Candida viswanathii* acetyl-carnitine translocase and the corresponding amino acid sequence (SEQ ID NO: 14). Nucleotide sequences encoding additional acetyl-carnitine translocase proteins include, but are not limited to: *Saccharomyces cerevisiae* CRC1 (Genbank accession number AJ250124) and *Aspergillus nidulans* AcuH (Genbank accession number AJ011563).

Presence, absence or amount of an acetyl-carnitine translocase activity can be detected by any suitable method known in the art and/or described herein. For example, detection can be performed using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cells or organisms exhibit increased or decreased RNA and/or polypeptide levels as compared to the host cell or organism. Methods of evaluating the activity of an acetyl-carnitine translocase include, for example, measuring carnitine uptake into and/or efflux from liposomes reconstituted with acetyl-carnitine translocase protein purified from microbial cells expressing the protein (see, e.g, Palmieri et al. (1999) *FEBS Lett* 462:472-276).

In another example, a host acetyl-carnitine translocase activity can be increased, for example, by increasing the number of copies of an acetyl-carnitine translocase gene (e.g., 1, 2, 3, 4, 5, 6, 7, 8, 9, 10, 15, 20, 25 or more copies of the gene), by increasing the activity of a promoter that regulates transcription of an acetyl-carnitine translocase gene, or by increasing the number of copies of an acetyl-carnitine translocase gene and increasing the activity of a promoter that regulates transcription of an acetyl-carnitine translocase gene. In some embodiments, an acetyl-carnitine translocase is endogenous to the host microorganism. Acetyl-carnitine translocase activities can also be increased, for example, by using an inducible promoter, e.g, a glucose- or fatty acid-inducible promoter for regulating transcription of an acetyl-carnitine translocase-encoding nucleic acid, and culturing the recombinant cell or microorganism in media containing a transcription-inducing carbon source.

Thus, in another example of modifying the expression of an acetyl-carnitine translocase in a cell, the promoter used for expression of nucleic acid encoding a mitochondrial acetyl-carnitine transport protein can be modified relative to an endogenous promoter encoding a transport protein. A promoter that is weaker, stronger and/or differently regulated than any endogenous mitochondrial acetyl-carnitine translocase gene promoter will provide for modified expression levels of the translocase protein. To achieve such modified expression, an endogenous promoter of a gene encoding a mitochondrial inner membrane acetyl-carnitine translocase can, in effect, be replaced with another promoter. This can be accomplished, for example, by introducing into a cell or microorganism a heterologous nucleic acid construct that includes a translocase-encoding sequence of nucleotides operably linked to a promoter that provides modified transcription or expression in the cell or microorganism relative to the endogenous promoter. The cell or microorganism can be one in which the endogenous gene(s) encoding a mitochondrial acetyl-carnitine translocase has been disrupted or deleted. For example, a host organism could be a yeast, e.g., a *Candida* yeast, in which the endogenous promoter of the mitochondrial acetyl-carnitine translocase includes an oleate-responsive element allowing for fatty acid induction. An example of a weaker promoter that would not be fatty acid inducible and provide for decreased acetyl-carnitine translocase expression, particularly when exposed to fatty acids as a carbon source, could be a yeast glucose-6-phosphate isomerase gene promoter. Modifying a promoter in this way provides another method for decreasing the amount and/or activity of acetyl-carnitine translocase protein in a host. This method is particularly advantageous when decreasing or eliminating acetyl-carnitine translocase activity through gene disruption is detrimental to cell growth and/or viability.

Modification of Mitochondrial Carnitine Acetyltransferase Activity

Acetyl-carnitine can be generated and degraded by the action of carnitine acetyltransferases (e.g., EC 2.3.1.7). In another embodiment provided herein, the amount of acetyl group carbons in the cytosol in the form of acetyl-carnitine in transit from the peroxisome to the mitochondria can be modified through altering the amount and/or activity of mitochondrial carnitine acetyltransferase. For example, by decreasing the activity level of mitochondrial carnitine acetyltransferase, there can be a corresponding decrease in conversion of acetyl-carnitine to acetyl-CoA in the mitochondria. This can introduce a bottleneck in acetyl-carnitine processing in the mitochondria which can have the effect of diverting acetyl-carnitine from entering the mitochondria from the cytoplasm. Alternatively, by increasing the activity level of mitochondrial carnitine acetyltransferase, there can be a corresponding increase in conversion of acetyl-carnitine to acetyl-CoA in the mitochondria which can augment acetyl-carnitine processing and avoid slowing of mitochondrial entry of acetyl-carnitine due to bottlenecks that might occur in the presence of increased amounts of acetyl-carnitine in the cytoplasm.

In some organisms, such as, for example, certain yeast species, carnitine acetyltransferase is dually targeted to mitochondria and peroxisomes by N-terminal and C-terminal targeting signals, respectively (see, e.g., Elgersma et al. (1995) *EMBO J.* 14: 3472-3479 and Kawachi et al. (1996) *Eur. J. Biochem.* 238: 845-852). An N-terminal sequence is referred to as the mitochondrial targeting signal (mts) and a C-terminal sequence is referred to as the peroxisomal targeting sequence (pts). An example of such an enzyme is the carnitine O-acetyltransferase enzyme encoded by some yeast CAT2 genes.

Modifying carnitine acetyltransferase activity in mitochondria can be accomplished by modifying the amount of mitochondrial carnitine acetyltransferase protein expression in a cell, for example, by replacing the wild-type promoter of an endogenous gene in a cell or organism with a weaker or stronger heterologous promoter, and/or replacing or modifying a gene encoding a wild-type carnitine acetyltransferase such that the encoded modified or substituted carnitine acetyltransferase protein has a reduced or increased enzyme activity. For example, a host carnitine acetyltransferase activity can be decreased by disruption (e.g., knockout, insertion mutagenesis, the like and combinations thereof) of a host gene encoding the protein, or by decreasing the activity of the promoter (e.g., through addition of repressor sequences to the promoter or 5'UTR or replacing the promoter) that controls transcription of a carnitine acetyltransferase gene using recombinant molecular biology techniques known in the art and/or described herein. In one embodiment, a diploid yeast, such as, for example, a Candida yeast, when used as a host microorganism can be subjected to genetic modification in which one of the two alleles of a mitochondrial carnitine acetyltransferase gene is disrupted or deleted. In so doing, a single allele of the gene remains for a reduced amount of carnitine acetyltransferase expression in the microorganism and a reduced amount of the protein in the mitochondria. This can effectively reduce and/or slow the amount of acetyl-carnitine that is processed into acetyl-CoA in the mitochondria without completely eliminating a minimal supply of acetyl carbons that may be required for cellular respiration that occurs in the mitochondria, yet provides for increased retention of acetyl-carnitine in the cytosol. In some instances, the amount of carnitine acetyltransferase activity remaining after disruption of a single allele of a mitochondrial carnitine acetyltransferase gene of a diploid cell or organism may be at a higher level than desired. In such cases, both alleles may be disrupted. A heterologous nucleic acid encoding a carnitine acetyltransferase that is less active than an endogenous carnitine acetyltransferase (or nucleic acid encoding a carnitine acetyltransferase that is linked to a weak promoter) can be introduced into host cells or organisms in which all alleles of the endogenous gene have been disrupted.

One method for disrupting an endogenous carnitine acetyltransferase gene is by recombinantly inserting a heterologous nucleic acid (e.g., a nucleotide sequence encoding a selectable marker such as an enzyme that restores an auxotrophic host cell or organism to prototrophy) into the endogenous gene, thereby generating an engineered cell or organism deficient in carnitine acetyltransferase activity. This can be done, for example, through homologous recombination in which a heterologous nucleic acid containing sequences of the endogenous carnitine acetyltransferase gene and a disrupting sequence (e.g., a knock-out gene cassette such as described herein) is introduced into a host cell or microorganism. Nucleic acids encoding a carnitine acetyltransferase can be obtained from a number of sources, including, for example, yeast cells. For example, genomic DNA from cell sources can be amplified using oligonucleotide primers based on the nucleotide sequence of a carnitine acetyltransferase-encoding gene. Provided herein, for example, are a nucleotide sequence (SEQ ID NO: 59) that encodes a Candida viswanathii carnitine acetyltransferase (CAT2 gene) and the corresponding amino acid sequence (SEQ ID NO: 2). Nucleotide sequences encoding additional carnitine acetyltransferase proteins include, but are not limited to: Saccharomyces cerevisiae CAT2 (Genbank accession numbers Z14021, NM_001182400), Candida tropicalis CAT2 (Genbank accession number D84549), Candida glabrata CAT2 (Genbank accession number AF2811), Candida albicans CAT2 (Genbank accession numbers AF525684), Aspergillus nidulans AcuJ (Genbank accession number XM_658791) and Cyberlindnera jadinii (Genbank accession number AB641826).

In cells or organisms in which a mitochondrial carnitine acetyltransferase is encoded by a gene that generates a protein containing mitochondrial and peroxisomal targeting sequences, it may be desired to modify only the mitochondrial enzyme, and continue expression of the peroxisomal enzyme. In this instance, an endogenous mitochondrial/peroxisomal carnitine acetyltransferase gene can be disrupted or deleted and heterologous nucleic acids separately encoding a mitochondrial-targeted enzyme and a peroxisomal-targeted enzyme can be introduced into the cell or microorganism. For example, a peroxisomal-targeted enzyme that would not be expressed in the mitochondria can be produced in a cell or microorganism by introducing a heterologous nucleic acid that encodes a carnitine acetyltransferase that includes a peroxisomal targeting sequence of amino acids but lacks a mitochondrial targeting sequence of amino acids. An example of such a modified Candida viswanathii nucleic acid sequence (CAT2$^{\Delta mts}$; SEQ ID NO: 60), and the amino acid sequence encoded thereby (Cat2p$^{\Delta mts}$; SEQ ID NO: 3), are provided herein. A mitochondrial-targeted carnitine acetyltransferase that would not be expressed in peroxisomes can be produced in a cell or microorganism by introducing a heterologous nucleic acid that encodes a carnitine acetyltransferase that includes a mitochondrial targeting sequence of amino acids but lacks a peroxisomal targeting sequence of amino acids. An example of such a modified Candida viswanathii nucleic acid sequence (CAT2$^{\Delta pts}$; SEQ ID NO: 62), and the amino acid sequence encoded thereby (Cat2p$^{\Delta pts}$; SEQ ID NO: 5), are provided herein. A heterologous nucleic acid encoding a mitochondrial-targeted carnitine acetyltransferase that would not be expressed in peroxisomes can also include modifications that alter its expression and or activity in the mitochondria as described herein. For example, regulatory sequences of nucleic acids (e.g, promoter sequences, repressor sequences) can be included that provide for decreased or increased expression of the enzyme and/or an altered pattern of expression of the enzyme. A heterologous nucleic acid encoding a mitochondrial-targeted carnitine acetyltransferase can include modifications that alter its activity, e.g., providing for more active or less active enzymatic activity relative to an endogenous mitochondrial carnitine acetyltransferase. The carnitine acetyltransferase activities of host and modified cells and microorganisms can be evaluated and monitored using methods known in the art. For example, methods of isolating peroxisomal and mitochondrial components of yeast cells and of extracting carnitine acetyltransferase from subcellular fractions have been described by Ueda et al. [(1982) Eur. J. Biochem. 124:205-210] and Kozulic et al. [(1987) Eur. J. Biochem. 168:245-250]. Methods of measuring the enzymatic activity of carnitine acetyltransferase are also known in the art, see, e.g., Fritz and Schultz (1965) J. Biol. Chem. 240:2188-2192; Chase (1969) Meth. Enzymol. 13:387-393.

In one embodiment provided herein, a heterologous nucleic acid encoding a yeast cytoplasmic carnitine acetyltransferase that has a reduced carnitine acetyltransferase activity relative to the activity of the enzyme encoded by a host microorganism's endogenous mitochondrial carnitine acetyltransferase gene can be introduced into a microbial host in which the endogenous mitochondrial carnitine acetyltransferase gene(s) has been disrupted or deleted. The heterologous nucleic acid encoding the less active carnitine acetyltransferase can be modified to include nucleotides encoding a mitochondrial targeting sequence for expression of the enzyme in the mitochondria. For example, in one aspect, a heterologous nucleic acid encoding a *Candida viswanathii* cytosolic carnitine acetyltransferase (YAT1) with added nucleotides encoding a mitochondrial targeting sequence (YAT1$^{+mts}$) can be introduced into a host cell or microorganism (e.g., a *Candida viswanathii* cell). Any sequence encoding a mitochondrial targeting from a protein that is localized to mitochondria can be used in generating the heterologous nucleic acid. Examples include, but are not limited to, nucleotides encoding mitochondrial targeting sequences from mitochondrial cytochrome oxidase subunit IV (Cox4p), mitochondrial citrate synthase (Cit1p) and mitochondrial carnitine acetyltransferase (Cat2p) proteins. Nucleotide sequences encoding (and the amino acid sequences of) *Candida viswanathii* Yat1p (amino acid SEQ ID NO: 6 and nucleotide SEQ ID NO: 63), YAT1$^{+mts}$p (amino acid SEQ ID NOS: 10, 11 and 12 and nucleotide SEQ ID NOS: 67, 68 and 69), and the mitochondrial targeting sequences of Cox4p (amino acid SEQ ID NO: 7 and nucleotide SEQ ID NO: 64), Cit1p (amino acid SEQ ID NO: 8 and nucleotide SEQ ID NO: 65) and Cat2p (amino acid SEQ ID NO: 9 and nucleotide SEQ ID NO: 66) are provided herein. Additional non-limiting examples of nucleic acids encoding cytoplasmic carnitine acetyltransferase include: *Saccharomyces cerevisiae* YAT1 (Genbank accession number X74553), *Aspergillus nidulans* FacC (Genbank accession number AF023156), *Cyberlindnera jadinii* YAT1 (Genbank accession number AB641829), *Candida dubliniensis* YAT1 (Genbank accession number XM_002416790) and *Candida albicans* (Genbank accession number AF525683). Additional non-limiting examples of nucleic acids encoding mitochondrial targeting sequences include *Saccharomyces cerevisiae* Cit1 (nucleotides in Genbank accession number NM_001183178 encoding N-terminal 37 amino acids) and *Saccharomyces cerevisiae* Cox4 (nucleotides in Genbank accession number NM_001181052 encoding N-terminal 25 amino acids).

In another example, the amount and/or activity of carnitine acetyltransferase in a cell or microorganism can be increased, for example, by increasing the number of copies of a carnitine acetyltransferase gene (e.g., 1, 2, 3, 4, 5, 6, 7, 8, 9, 10, 15, 20, 25 or more copies of the gene), by increasing the activity of a promoter that regulates transcription of a carnitine acetyltransferase gene, or by increasing the number of copies of a carnitine acetyltransferase gene and increasing the activity of a promoter that regulates transcription of a carnitine acetyltransferase gene. In some embodiments, a carnitine acetyltransferase is endogenous to the host cell or microorganism. Carnitine acetyltransferase activities can also be increased, for example, by using an inducible promoter, e.g, a glucose- or fatty acid-inducible promoter for regulating transcription of a carnitine acetyltransferase-encoding nucleic acid, and culturing the recombinant cell or microorganism in media containing a transcription-inducing carbon source.

Thus, in another example of modifying the expression of a carnitine acetyltransferase in a cell, the promoter used for expression of nucleic acid encoding a carnitine acetyltransferase protein can be modified relative to an endogenous promoter encoding a carnitine acetyltransferase protein. A promoter that is weaker, stronger and/or differently regulated than any endogenous carnitine acetyltransferase gene promoter will provide for modified expression levels of the protein. To achieve such modified expression, an endogenous promoter of a gene encoding a carnitine acetyltransferase can, in effect, be replaced with another promoter. This can be accomplished, for example, by introducing into a cell or microorganism a heterologous nucleic acid construct that includes a carnitine acetyltransferase-encoding sequence of nucleotides operably linked to a promoter that provides modified expression in the cell or microorganism relative to the endogenous promoter. The cell or microorganism can be one in which the endogenous gene(s) encoding a carnitine acetyltransferase has been disrupted or deleted. For example, a host organism could be a yeast, e.g., a *Candida* yeast, in which the endogenous promoter includes an oleic acid-responsive element allowing for fatty acid induction. An example of a weaker promoter that would not be fatty acid inducible and provide for decreased carnitine acetyltransferase expression, particularly when exposed to fatty acids as a carbon source, could be a yeast glucose-6-phosphate isomerase gene promoter.

Different combinations of transcription regulatory elements (e.g., promoters) and enzymes can be utilized to achieve an optimal level of activity of carnitine acetyltransferase (or other enzyme being modified) in a cell or microorganism modified to alter carbon flux therein. For example, in embodiments in which a decreased level, but not an elimination, of an activity, such as mitochondrial carnitine acetyltransferase, in a cell or organism is desired, an optimal activity level may be achieved by using a strong and/or inducible promoter to express nucleic acid encoding a protein having a decreased activity. In one embodiment described herein, the mitochondrial carnitine acetyltransferase activity of a host organism (e.g., *Candida* yeast) is decreased by disrupting both alleles of the endogenous gene encoding mitochondrial carnitine acetyltransferase and introducing heterologous nucleic acid encoding a mitochondrial-targeted carnitine acetyltransferase having a lower enzyme activity than the endogenous mitochondrial carnitine acetyltransferase. To ensure that the level of enzyme activity provided by the less active mitochondrial-targeted carnitine acetyltransferase is sufficient and optimal in the modified cell, a strong, fatty acid-inducible promoter (e.g., an HDE gene promoter) can be linked to the nucleic acid encoding the less active enzyme to regulate transcription and production of a desired amount of the enzyme.

Modification of Cytosolic Carnitine Acetyltransferase Activity

Included in embodiments of the cells, microorganisms, compositions and methods provided herein are microbial production platform systems and components thereof in which the amount of carnitine acetyltransferase in the cell cytosol and/or carnitine acetyltransferase activity in the cell cytosol is modified. In some instances, the amount of carnitine acetyltransferase in the cell cytosol is increased and/or decreased, and/or carnitine acetyltransferase activity in the cell cytosol is increased and/or decreased. For example, in some aspects, a cell or microorganism may be modified to increase cytosolic carnitine acetyltransferase and/or carnitine acetyltransferase activity, may be modified to decrease cytosolic carnitine acetyltransferase and/or carnitine acetyltransferase activity, or may be modified to alternately increase and decrease cytosolic carnitine acetyltransferase and/or carnitine acetyltransferase activity depending on the conditions in which the modified cell or microorganism is cultured.

In some embodiments, the capture of carbon atoms in the acetyl group of acetyl-CoA generated from metabolic processes such as peroxisomal β-oxidation can be accomplished by increasing the amount of carnitine acetyltransferase protein and/or activity in the cell cytosol of a cell or microorganism. In so doing, there is an increased conversion of acetyl-carnitine, such as that which is in transit from the peroxisome to the mitochondria, into acetyl-CoA in the cytoplasm. In one aspect, the amount and/or activity of a host cytosolic carnitine acetyltransferase can be increased, for example, by increasing the number of copies of a gene encoding a cytoplasmic carnitine acetyltransferase (e.g., 1, 2, 3, 4, 5, 6, 7, 8, 9, 10, 15, 20, 25 or more copies of the gene), by increasing the activity of a promoter that regulates transcription of a gene encoding a cytoplasmic carnitine acetyltransferase, or by increasing the number of copies of a gene encoding a cytoplasmic carnitine acetyltransferase and increasing the activity of a promoter that regulates transcription of a gene encoding a cytoplasmic carnitine acetyltransferase. In some embodiments, a cytoplasmic carnitine acetyltransferase is endogenous to the host cell or microorganism.

In one embodiment of the cell and microbial systems and methods provided herein, the amount of carnitine acetyltransferase protein expressed in the cytosol can be increased by introducing heterologous nucleic acid encoding a cytoplasmic carnitine acetyltransferase into a cell or microorganism. In some cells and microorganisms, e.g., some yeast strains, cytoplasmic carnitine acetyltransferase is encoded by a gene that is distinct from the gene(s) encoding mitochondrial and/or peroxisomal carnitine acetyltransferase. For example, in some yeast strains, a cytoplasmic carnitine acetyltransferase is encoded by a YAT gene, whereas a mitochondrial and/or peroxisomal carnitine acetyltransferase is encoded by a CAT gene. Nucleotide sequences encoding (and the amino acid sequences of) *Candida viswanathii* Yat1p (amino acid SEQ ID NO: 6 and nucleotide SEQ ID NO: 63) are provided herein. Additional non-limiting examples of nucleic acids encoding cytoplasmic carnitine acetyltransferase include *Saccharomyces cerevisiae* YAT1 (Genbank accession number X74553), *Aspergillus nidulans* FacC (Genbank accession number AF023156), *Cyberlindnera jadinii* YAT1 (Genbank accession number AB641829), *Candida dubliniensis* YAT1 (Genbank accession number XM_002416790) and *Candida albicans* (Genbank accession number AF525683).

In another embodiment, the amount of cytoplasmic carnitine acetyltransferase can be modified by modifying the activity of a promoter that regulates transcription of a gene encoding a cytoplasmic carnitine acetyltransferase. Thus, in another example of modifying the expression of a cytosolic carnitine acetyltransferase in a cell, the promoter used for expression of nucleic acid encoding a cytosolic carnitine acetyltransferase protein can be modified relative to an endogenous promoter encoding a cytosolic carnitine acetyltransferase protein. A promoter that is weaker, stronger and/or differently regulated than any endogenous cytosolic carnitine acetyltransferase gene promoter will provide for modified expression levels of the protein. To achieve such modified expression, an endogenous promoter of a gene encoding a cytosolic carnitine acetyltransferase can, in effect, be replaced with another promoter. This can be accomplished, for example, by introducing into a cell or microorganism a heterologous nucleic acid construct that includes a cytosolic carnitine acetyltransferase-encoding sequence of nucleotides operably linked to a promoter that provides modified expression in the cell or microorganism relative to the endogenous promoter. The cell or microorganism can be one in which the endogenous gene(s) encoding a cytosolic carnitine acetyltransferase has been disrupted or deleted. For example, a host organism could be a yeast, e.g., a *Candida* yeast, in which the endogenous promoter does not include an oleic acid-responsive element allowing for fatty acid induction. An example of a stronger promoter that would be fatty acid inducible and provide for increased cytosolic carnitine acetyltransferase expression, particularly when exposed to fatty acids as a carbon source, is a peroxisomal protein gene and/or β-oxidation enzyme gene promoter, e.g., a *Candida* hydratase-dehydrogenase-epimerase (HDE) gene promoter. The nucleotide sequence of a *Candida viswanathii* HDE gene promoter (SEQ ID NO: 113) is provided herein as are examples of additional fatty acid-inducible promoters.

In a further embodiment, cytosolic carnitine acetyltransferase activity can be modified by introducing into a cell or microorganism a heterologous nucleic acid encoding a carnitine acetyltransferase that is more active or less active than an endogenous cytosolic carnitine acetyltransferase. For example, a heterologous nucleic acid encoding an enzyme that has an increased carnitine acetyltransferase activity relative to the activity of a cytosolic carnitine acetyltransferase expressed in the host cell or microorganism can be introduced into a host to provide for increased generation of cytosolic acetyl-CoA from acetyl-carnitine. The host can be one in which the endogenous cytosolic carnitine acetyltransferase gene(s) has been disrupted or deleted. The heterologous nucleic acid encoding the more active carnitine acetyltransferase can, if required, be altered to exclude any nucleotides encoding a cell localization (e.g., mitochondria, peroxisomes) targeting sequence in order to provide for expression of the enzyme in the cytosol.

Thus, for example, engineered carnitine O-acetyltransferase proteins lacking amino acid sequence targeting signals that direct the enzyme to one or more cellular locations other than the cytoplasm can be expressed in host cells thereby increasing the amount of carnitine O-acetyltransferase in the cytoplasm. Such engineered proteins will remain in the cytoplasm after being produced by the cell or organism. One such modified carnitine O-acetyltransferase protein is a yeast Cat2p$^{\Delta mts\Delta pts}$ lacking a mitochondrial targeting signal (mts) and a perioxisomal targeting signal (pts). In some instances, a mitochondrial and/or peroxisomal carnitine acetyltransferase (e.g., a yeast Cat2p) may be more active than an endogenous cytosolic carnitine acetyltransferase (e.g., a yeast Yat1p). A more active Cat2p enzyme can be expressed in the cytosol of a host upon introduction of heterologous nucleic acid (e.g., CAT2$^{\Delta mts\Delta pts}$) encoding the more active enzyme lacking mitochondrial- and peroxisomal-targeting sequences. In a particular embodiment, the Cat2p enzyme can be a *Candida* yeast protein. An example of a *Candida viswanathii* nucleotide sequence (CAT2$^{\Delta mts\Delta pts}$; SEQ ID NO: 61) encoding a carnitine acetyltransferase lacking mitochondrial- and peroxisomal-targeting sequences (Cat2p$^{\Delta mts\Delta pts-}$, SEQ ID NO: 4) is provided herein.

Additional examples of nucleotide sequences encoding carnitine acetyltransferase proteins include: *Saccharomyces cerevisiae* CAT2 (Genbank accession numbers Z14021, NM_001182400), *Candida tropicalis* CAT2 (Genbank accession number D84549), *Candida glabrata* CAT2 (Genbank accession number AF2811), *Candida albicans* CAT2

(Genbank accession numbers AF525684), *Aspergillus nidulans* AcuJ (Genbank accession number XM_658791), *Neurospora crassa* (Genbank accession number XM_957579) and *Cyberlindnera jadinii* CAT2 (Genbank accession number AB641826). Any of these, and other such carnitine acetyltransferase-encoding nucleic acids, can be analyzed for the presence of 5' and 3' ORF nucleotides encoding possible mitochondrial- or peroxisomal-targeting sequences of amino acids and modified to eliminate such sequences. For example, the initial approximately 66 base pairs of the *Saccharomyces cerevisiae* CAT2 or the *Candida tropicalis* CAT2 coding sequence can be excluded to eliminate mitochondrial targeting of the enzyme, while deletion of the terminal 9 base pairs of the coding sequence that encode a 3-amino acid persoxisomal targeting sequence, i.e., PTS1, (AKL or PKL motif) eliminates peroxisomal targeting of the enzyme (see, e.g., Elgersma et al. (1995) *EMBO J.* 14:3472-3479 and Kawachi et al. (1996) *J. Biochem.* 120:731-735). Similarly, the initial approximately 120 base pairs of the *Aspergillus nidulans* AcuJ coding sequence can be excluded to possibly eliminate mitochondrial targeting of the enzyme, while deletion of the terminal 9 base pairs of the coding sequence that encode a 3-amino acid PTS1 (AKL motif) may eliminate peroxisomal targeting of the enzyme (see, e.g., Hynes et al. (2011) *Eukarot. Cell* 10:547-555). In general, yeast mitochondrial targeting sequences occur within the initial 10-90 N-terminal amino acid residues of a mitochondrial protein, have a significant arginine composition and very few to no negatively charged residues. Prediction tools, e.g., MitoProt, TargetP, Predotar and TPpred2, can be used in evaluating an amino acid sequence for identification of possible mitochondrial targeting sequences (see, e.g., Claros (1995) *Comput. Appl. Sci.* 11:441-447; Emanuelsson et al. (2000) *J. Mol. Biol.* 300:1005-1016; Small et al. (2004) *Proteomics* 4:1581-1590; Savojardo et al. (2014) *Bioinformatics* 30:2973-2974). Yeast peroxisomal targeting sequences generally occur at the C-terminus of a peroxisomal protein. Generally, the 3-amino acid consensus sequence of a yeast PTS1 has an initial amino acid containing a small, uncharged side chain (e.g., serine, alanine and cysteine), followed by a positively charged residue (e.g., lysine, arginine and histidine) and ending with a leucine residue; however, variants (e.g., PKL and others) of the consensus sequence do occur. Another example of a peroxisomal targeting signal sequence is the tripeptide AKI of the *Candida tropicalis* trifunctional enzyme hydratase-dehydrogenase-epimerase (HDE) (see, e.g., Aitchison et al. (1991) *J. Biol. Chem.* 266(34):23197-23203. Prediction tools, e.g., PTSI Predictor (mendel.imp.ac.at/mendeljsp/sat/ptsl/PTSl-predictor.jsp), can be used in evaluating an amino acid sequence for identification of possible peroxisomal targeting signal sequences (see, e.g., Brocard and Hartig (2006) *Biochim. Biophys. ACTA* 1763:1565-1573).

The promoter used for regulating transcription of a heterologous nucleic acid encoding a carnitine acetyltransferase that is more active or less active than an endogenous cytosolic carnitine acetyltransferase can also be modified. For example, the amount of a more active carnitine acetyltransferase protein expressed in the cytosol may be increased by including in the heterologous nucleic acid a stronger heterologous promoter and/or a promoter that provides for a different pattern of expression in the cell or microorganism.

Alternatively, decreasing carnitine acetyltransferase activity in the cytosol can be accomplished by modifying the amount of cytosolic carnitine acetyltransferase protein expression in a cell, for example, by replacing the wild-type promoter of an endogenous cytosolic carnitine acetyltransferase gene in a cell or organism with a weaker heterologous promoter, deleting or disrupting an endogenous gene, and/or replacing or modifying a gene encoding a wild-type cytosolic carnitine acetyltransferase such that the encoded modified or substituted carnitine acetyltransferase protein has a reduced enzyme activity. For example, expression of a host cytosolic carnitine acetyltransferase activity can be decreased by disruption (e.g., knockout, insertion mutagenesis, the like and combinations thereof) of a host gene encoding the protein, or by decreasing the activity of the promoter (e.g., through addition of repressor sequences to the promoter or 5'UTR or replacing the promoter) that controls transcription of a cytosolic carnitine acetyltransferase gene using recombinant molecular biology techniques known in the art and/or described herein. In one embodiment, a diploid yeast, such as, for example, a *Candida* yeast, when used as a host microorganism can be subjected to genetic modification in which one of the two alleles of a cytosolic carnitine acetyltransferase gene is disrupted or deleted. In so doing, a single allele of the gene remains for a reduced amount of carnitine acetyltransferase expression in the microorganism and a reduced amount of the protein in the cytosol. This effectively reduces and/or slows the amount of acetyl-carnitine that is processed into acetyl-CoA in the cytosol.

One method for disrupting an endogenous carnitine acetyltransferase gene is by recombinantly inserting a heterologous nucleic acid (e.g., a nucleotide sequence encoding a selectable marker such as an enzyme that restores an auxotrophic host organism to prototrophy) into the endogenous gene, thereby generating an engineered organism deficient in cytosolic carnitine acetyltransferase activity. This can be done, for example, through homologous recombination in which a heterologous nucleic acid containing sequences of the endogenous cytosolic carnitine acetyltransferase gene and a disrupting sequence (e.g., a knock out gene cassette as described herein) is introduced into a host cell or microorganism. Nucleic acids encoding a cytosolic carnitine acetyltransferase can be obtained from a number of sources, including, for example, yeast cells. Genomic DNA from cell sources can be amplified using oligonucleotide primers based on the nucleotide sequence of a cytosolic carnitine acetyltransferase-encoding gene. For example, in some yeast strains, a cytosolic carnitine acetyltransferase is encoded by a YAT gene. Nucleotide sequences encoding (and the amino acid sequences of) *Candida viswanathii* Yat1p (amino acid SEQ ID NO: 6 and nucleotide SEQ ID NO: 63) are provided herein. Additional non-limiting examples of nucleic acids encoding cytoplasmic carnitine acetyltransferase include *Saccharomyces cerevisiae* YAT1 (Genbank accession number X74553), *Aspergillus nidulans* FacC (Genbank accession number AF023156), *Cyberlindnera jadinii* YAT1 (Genbank accession number AB641829), *Candida dubliniensis* YAT1 (Genbank accession number XM_002416790) and *Candida albicans* (Genbank accession number AF525683).

Modification of Acetyl-CoA Generation Through Oxidative Metabolism

Included in the biological production platform systems and components thereof provided herein are embodiments in which the generation of acetyl-CoA in a cell or organism is modified. In some embodiments, the cellular processing of fatty acids, such as those obtained from external carbon sources (e.g., non-fermentable carbon sources) and internal, cell-generated sources (including, for example, but not limited to, fatty acids generated by catabolism of alkanes, fatty alcohols and fatty aldehydes), can be directed toward acetyl-CoA-generating oxidative metabolism pathways in cells. In some embodiments, the processing of fatty acids can be directed toward oxidative metabolism (e.g., ω- and/or β-oxidation) and away from cellular pathways, such as lipid synthesis pathways, that may not be involved in target molecule production. Accordingly, provided herein are cells, organisms, compositions and methods in which cellular carbon flux has been modified through alterations in cellular oxidative metabolism and/or fatty acid activation. In particular embodiments, cellular carbon flux has been modified to increase the production of acetyl-CoA in a cell through altering oxidative metabolism and/or fatty acid activation. Carbon flux modifications involving oxidative metabolism are particularly useful in embodiments in which alternative, non-carbohydrate carbon sources (e.g., some non-fermentable carbon sources) are used as a feedstock for modified cells and organisms in target molecule production.

For example, some organisms (e.g., some species of *Candida*, *Yarrowia*, *Pichia*, *Debaryomyces*, *Acinetobacter*, *Bacillus*, *Mycobaterium*, *Pseudomonas*, *Sphingomonas*, *Alcanivorax* and *Rhodococcus*) are able to endogenously assimilate alkanes as a carbon source. A primary pathway for alkane assimilation (also referred to as monoterminal alkane oxidation), which occurs in association with the endoplasmic reticulum and peroxisomes in eukaryotes, is through the initial conversion of alkanes to fatty acids which can then be metabolized in the cells. The conversion can occur through a three-step process as follows: (1) terminal hydroxylation of alkane by a cytochrome P450-dependent monooxygenase system (e.g, ALK gene products of the CYP52 family as a terminal oxidase and an NADPH-dependent cytochrome P450 reductase (e.g., CPR1-encoded) for electron transfer) which yields a fatty alcohol; (2) conversion of the terminal hydroxy group of the alcohol to a fatty aldehyde in reactions involving fatty alcohol dehydrogenase (e.g., ADH) or fatty alcohol oxidase (e.g., FAO); and (3) conversion of the fatty aldehyde to a fatty acid by a fatty aldehyde dehydrogenase. The resulting fatty acid can then be subject to the same metabolic processing as is a fatty acid taken up directly by the organism.

Fatty acids can be metabolized in several ways depending on the type of cell or organism. Many fatty acid metabolic pathways, including β-oxidation, lipid biosynthesis, and protein acylation, require that a fatty acid be activated by thioesterification to coenzyme A (i.e., acyl-CoA), or to an acyl carrier protein (i.e., acyl-ACP), prior to being metabolized. As used herein, "activation" with reference to fatty acids refers to the thioesterification of a fatty acid with a carrier molecule such as coenzyme A (Co-A) or acyl carrier protein (ACP). A fatty acid that has undergone activation into an acyl-CoA or fatty acid-ACP molecule is referred to as an activated fatty acid. The thioesterification reaction can be catalyzed by acyl-CoA synthetase enzymes. There are multiple enzymes having acyl-CoA synthetase activity in cells which differ based on cellular localization (e.g., plasma membrane, cytosol, endoplasmic reticulum membrane, peroxisomes) and substrate (e.g., fatty acid carbon chain length) specificity. In general, plasma membrane-associated acyl-CoA synthetases often are more specific for very long chain fatty acids and are involved in transport of these hydrophobic molecules across the membrane concurrent with activation of the fatty acids to acyl-CoA. Once activated, the acyl-CoA can then be used in a number of metabolic pathways, only one of which is β-oxidation. Thus, fatty acids activated at the plasma membrane and/or in the cytosol can represent possible "losses" of carbon atoms to cellular synthesis pathways (e.g., lipid synthesis) at the expense of other target molecule production pathways (e.g., oxidative metabolism, malonyl-CoA production and organic acid, polyketide and/or terpene synthesis). Therefore, in some embodiments of cells and organisms provided herein for use in target molecule production systems, it can be beneficial to capture the carbon atoms of free fatty acids for use in target molecule production and decrease activated fatty acid (e.g., acyl-CoA) flow into cellular pathways not associated with target molecule production. As described herein, methods of enhancing fatty acid carbon flow through oxidative metabolism include, but are not limited to, modification of activities of cellular ω- and/or β-oxidation systems and acyl-CoA synthetase activities.

Modification of ω-Oxidation

In the oxidative metabolism pathway referred to as ω-oxidation (or diterminal oxidation), fatty acids can be converted to dicarboxylic acids (diacids). Several enzyme activities (e.g., cytochrome P450 hydroxylase complex, fatty alcohol oxidase and fatty aldehyde dehydrogenase) can be involved in the process of ω-oxidation. The term "ω-oxidation pathway" as used herein, refers to a cellular metabolic pathway constituted by a series of enzymatic activities through which fatty acids and alkanes are converted to dicarboxylic acids. Some cells and microorganisms (e.g., species of yeast and bacteria) endogenously express the enzyme activities, and those that do not can be genetically modified to provide a heterologous w-oxidation pathway by introducing nucleic acids encoding the required enzymes into cells and expressing the proteins therein. Free fatty acids internalized into cells, or generated within cells (e.g., by oxidation of internalized alkanes), can directly enter into and be processed in the w-oxidation pathway without prior activation to acyl-CoA. In some embodiments of the cell-based production systems and methods provided herein, dicarboxylic acids can be a target molecule. In some embodiments, e.g., in which some shorter-chain dicarboxylic acids are a target molecule, or dicarboxylic acids are not a target molecule (or a co-target molecule along with one or more other desired products), dicarboxylic acids generated by ω-oxidation can be further oxidized through β-oxidation. Dicarboxylic acids can traverse peroxisomal membranes in eukaryotic cells and be metabolized to yield acetyl-CoA that can be used in target molecule generation. Because free fatty acids can be processed through ω-oxidation without being activated by thioesterification with Co-A, and diacids resulting from ω-oxidation of fatty acids readily move into peroxisomes, the ω-oxidation pathway can serve as a cellular gateway for funneling internalized fatty acids into oxidative metabolism and away from cytosolic activation that is required for use of fatty acids in other cellular pathways that may not be involved in target molecule production.

The term "ω-oxidation activity" refers to any of the activities in the ω-oxidation pathway utilized to metabolize alkanes and fatty acids. The activities that may be utilized in this metabolic pathway include, but are not limited to, monooxygenase activity (e.g., cytochrome P450 activity), monooxygenase reductase activity (e.g., cytochrome P450 reductase activity), alcohol dehydrogenase activity (e.g., fatty alcohol dehydrogenase activity or long-chain alcohol dehydrogenase activity), fatty alcohol oxidase activity and fatty aldehyde dehydrogenase activity. In some embodiments of the cells, organisms, compositions and methods provided herein, the ω-oxidation activity of a cell or organism is modified. In one embodiment, one or more of the activities in the ω-oxidation pathway can be modified. In particular embodiments, one or more of the activities in the ω-oxidation pathway can be increased.

Modification of a Monooxygenase Activity

The initial step in the ω-oxidation pathway is the conversion of a fatty acid to a corresponding fatty alcohol and involves NADPH and molecular oxygen. A cytochrome P450 enzyme (e.g., monooxygenase activity, EC 1.14.14.1) often catalyzes the insertion of one atom of oxygen bound to the heme group in cytochrome P450 into an organic substrate (RH) while the other oxygen atom is reduced to water. A cytochrome P450 reductase catalyzes the reductive splitting of the oxygen and transfer of electrons from NADPH to cytochrome P450. Insertion of the oxygen atom near the omega carbon of a substrate yields an alcohol derivative of the original starting substrate (e.g., yields a fatty alcohol). In some embodiments of the cells, organisms, compositions and methods provided herein, the amount and/or activity of a monooxygenase in a cell is modified. For example, in some aspects, a cell or microorganism may be modified to increase the amount and/or activity of a monooxygenase, may be modified to decrease the amount and/or activity of a monooxygenase, or may be modified to alternately increase and decrease the amount and/or activity of a monooxygenase depending, for example, on the cellular location(s) of the enzyme and/or on the conditions in which the modified cell or microorganism is cultured.

In certain aspects, the amount and/or activity of a monooxygenase in a cell is increased. Increasing the amount and/or activity of a monooxygenase may be particularly beneficial in embodiments in which the flux of carbons from fatty acids is directed toward a particular target product pathway involving oxidative metabolism and away from other cellular metabolic pathways not involved in target molecule production.

In certain embodiments, the monooxygenase activity is unchanged in a host or engineered cell or organism. In one embodiment, the amount and/or activity of a host monooxygenase can be increased, for example, by increasing the number of copies of a nucleic acid encoding a monooxygenase (e.g., 1, 2, 3, 4, 5, 6, 7, 8, 9, 10, 15, 20, 25 or more copies of the nucleic acid), by increasing the activity of a promoter that regulates transcription of a nucleic acid encoding a monooxygenase, or by increasing the number of copies of a nucleic acid encoding a monooxygenase and increasing the activity of a promoter that regulates transcription of a nucleic acid encoding a monooxygenase. In some embodiments, a monooxygenase is endogenous to the host cell or microorganism. In one aspect of the cell or microbial systems and methods provided herein, the amount of monooxygenase protein expressed in a cell can be increased by introducing heterologous nucleic acid encoding a monooxygenase into a cell or microorganism. For example, introduction of heterologous nucleic acid encoding a monooxygenase can result in increased copy number of such nucleic acids and/or provide for modification of the cellular location in which the protein is expressed.

In some embodiments, a cytochrome P450 monooxygenase enzyme can be a fungal or bacterial protein. In a particular embodiment, the monooxygenase enzyme can be a *Candida* (e.g., *C. tropicalis*, *C. viswanathii*, *C. maltosa*, *C. cloacae*), *Yarrowia* (e.g., *Y. lipolytica*), *Fusarium* (e.g., *F. oxysporum*), *Bacillus* (e.g., *B. megaterium*, *B. subtilis*) protein. *Candida tropicalis* contains a family of cytochrome P450 genes referred to as CYP genes. Examples of *Candida viswanathii* nucleotide sequences encoding polypeptides having monooxygenase activities are provided herein (nucleotide SEQ ID NO: 99 and amino acid SEQ ID NO: 45) and in International patent application no. PCT/US2012/045615 (publication no. WO 2013/106730). Additional non-limiting examples of nucleotide sequences encoding polypeptides having monooxygenase activity include: *Candida tropicalis* CYP52A12 (Genbank accession no. AY230498), *Candida tropicalis* CYP52A13 (Genbank accession no. AY230499), *Candida tropicalis* CYP52A14 (Genbank accession no. AY230500), *Candida tropicalis* CYP52A15 (Genbank accession no. AY230501), *Candida tropicalis* CYP52A16 (Genbank accession no. AY230502), *Candida tropicalis* CYP52A17 (Genbank accession no. AY230504), *Candida tropicalis* CYP52A18 (Genbank accession no. AY230505), *Candida tropicalis* CYP52A19 (Genbank accession no. AY230506), *Candida tropicalis* CYP52A20 (Genbank accession no. AY230507), *Candida tropicalis* CYP52D2 (Genbank accession no. AY230503), *Bacillus megaterium* CYPBM3 (Genbank accession no. KC839476) and *Fusarium oxysporum* CYP505 (Genbank accession no. AB030037).

Monooxygenase activity can be provided by any suitable polypeptide, such as a cytochrome P450 polypeptide (CYP450) in certain embodiments. Examples of a polypeptide having CYP450 activity include CYP52A12, a CYP52A13, a CYP52A14, a CYP52A15, a CYP52A16, a CYP52A17, a CYP52A18, a CYP52A19, a CYP52A20, a CYP52D2, and/or a BM3. In some embodiments, the activity can be a single polypeptide with both monooxygenase and monooxygenase reductase activities (e.g., *B. megaterium* cytochrome P450:NADPH P450 reductase, *Fusarium oxysporum* CYP505). Presence, absence or amount of cytochrome P450 activity can be detected by any suitable method known in the art. For example, detection can be performed by assaying a reaction containing cytochrome P450 (CYP52A family) and NADPH-cytochrome P450 reductase (see, e.g., Craft et al. (2003) *Appl. Environ. Microbiol.* 69: 5983 and 5992). Nucleic acid sequences encoding native and/or modified CYP450 sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a heterologous nucleic acid encoding a monooxygenase can also be modified. For example, the amount of a monooxygenase protein expressed in a particular cellular location may be increased by including in the heterologous nucleic acid a strong heterologous promoter and/or a promoter that provides for a different pattern of expression in the cell or microorganism. An example of one such heterologous promoter is a *Candida* hydratase-dehydrogenase-epimerase (HDE) gene promoter. The nucleotide sequence of a *Candida viswanathii* HDE gene promoter is provided herein as are examples of additional fatty acid-inducible promoters. Promoter elements from different monooxygenase-encoding genes can have differing responsiveness to induction by various carbon sources. Thus, the amount of a monooxygenase protein expressed in a cell or organism can be modified by using heterologous promoters from different cytochrome P450 monoxygenase genes to regulate transcription of a monoxgenase-encoding nucleic acid that is introduced into a host cell and by the carbon source provided to the modified cell or organism. Non-limiting examples of assays suitable for assessing induction of cytochrome P450

(or other protein) expression by a carbon source or feedstock include RT-PCR or qRT-PCR after the host cell or microorganism has been exposed to the chosen carbon source or feedstock for varying amounts of time.

Decreasing monooxygenase activity in a cell can be accomplished by modifying the amount of monooxygenase protein expression in the cell, for example, by replacing the wild-type promoter of an endogenous monooxygenase gene in a cell or organism with a weaker heterologous promoter, deleting or disrupting an endogenous gene, and/or replacing or modifying a gene encoding a wild-type monooxygenase such that the encoded modified or substituted monooxygenase protein has a reduced enzyme activity.

Modification of a Cytochrome P450 Reductase Activity

A cytochrome P450 reductase (e.g., monooxygenase reductase activity or NADPH:cytochrome oxidoreductase (NCP); EC 1.6.2.4) can catalyze the reduction of the heme-thiolate moiety in cytochrome P450 by transferring electrons to the cytochrome P450. This activity recycles cytochrome P450 and makes it available for further use in catalyzing reactions that occur in w-oxidation of fatty acids. In some embodiments of the cells, organisms, compositions and methods provided herein, the amount and/or activity of a cytochrome P450 reductase in a cell is modified. For example, in some aspects, a cell or microorganism may be modified to increase the amount and/or activity of a cytochrome P450 reductase, may be modified to decrease the amount and/or activity of a cytochrome P450 reductase, or may be modified to alternately increase and decrease the amount and/or activity of a cytochrome P450 reductase depending, for example, on the cellular location(s) of the enzyme and/or on the conditions in which the modified cell or microorganism is cultured.

In certain aspects, the amount and/or activity of a cytochrome P450 reductase in a cell is increased. Increasing the amount and/or activity of a cytochrome P450 reductase may be particularly beneficial in embodiments in which the flux of carbons from fatty acids is directed toward a particular target product pathway involving oxidative metabolism and away from other cellular metabolic pathways not involved in target molecule production.

In certain embodiments, the cytochrome P450 reductase activity is unchanged in a host or engineered cell or organism. In one embodiment, the amount and/or activity of a host cytochrome P450 reductase can be increased, for example, by increasing the number of copies of a nucleic acid encoding a cytochrome P450 reductase (e.g., 1, 2, 3, 4, 5, 6, 7, 8, 9, 10, 15, 20, 25 or more copies of the nucleic acid), by increasing the activity of a promoter that regulates transcription of a nucleic acid encoding a cytochrome P450 reductase, or by increasing the number of copies of a nucleic acid encoding a cytochrome P450 reductase and increasing the activity of a promoter that regulates transcription of a nucleic acid encoding a cytochrome P450 reductase. In some embodiments, a cytochrome P450 reductase is endogenous to the host cell or microorganism. In one aspect of the cell or microbial systems and methods provided herein, the amount of cytochrome P450 reductase protein expressed in a cell can be increased by introducing heterologous nucleic acid encoding a cytochrome P450 reductase into a cell or microorganism. For example, introduction of heterologous nucleic acid encoding a cytochrome P450 reductase can result in increased copy number of such nucleic acids and/or provide for modification of the cellular location in which the protein is expressed.

In some embodiments, a cytochrome P450 reductase enzyme can be a yeast or bacterial protein. In a particular embodiment, the reductase enzyme can be a Candida (e.g., C. tropicalis, C. viswanathii, C. maltosa, C. cloacae), Yarrowia (e.g., Y. lipolytica) or Bacillus (e.g., B. megaterium) protein. In a particular embodiment, the cytochrome P450 reductase enzyme can be a Candida yeast protein. Candida tropicalis contains two alleles of a cytochrome P450 reductase gene referred to as CPRa and CPRb. Examples of Candida viswanathii nucleotide sequences encoding cytochrome P450 reductase activities are provided herein (nucleotide SEQ ID NO: 90 and amino acid SEQ ID NO: 45) and in International patent application no. PCT/US2012/045615 (publication no. WO 2013/106730). Additional non-limiting examples of nucleotide sequences encoding polypeptides having cytochrome P450 reductase activity include: Candida tropicalis (Genbank accession nos. AY705446, AY823228), Candida bombicola (Genbank accession no. EF050789), Bacillus megaterium CYPBM3 (Genbank accession no. KC839476), Bacillus megaterium (Genbank accession no. FJ859036).

Presence, absence or amount of cytochrome P450 reductase activity can be detected by any suitable method known in the art. For example, detection can be performed by assaying a reaction containing cytochrome c and NADPH and measuring the rate of cytochrome reduction by monitoring absorbance (see, e.g., He and Chen (2005) Yeast 22:481-491; Van Bogaert et al. (2007) Yeast 7:922-928). Nucleic acid sequences encoding native and/or modified cytochrome P450 reductase also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits increased or decreased RNA and/or polypeptide levels as compared to the host cell or organism.

The promoter used for regulating transcription of a heterologous nucleic acid encoding a cytochrome P450 reductase can also be modified. For example, the amount of a cytochrome P450 reductase protein expressed in a particular cellular location may be increased by including in the heterologous nucleic acid a strong heterologous promoter and/or a promoter that provides for a different pattern of expression in the cell or microorganism. An example of one such heterologous promoter is a Candida hydratase-dehydrogenase-epimerase (HDE) gene promoter. The nucleotide sequence of a Candida viswanathii HDE gene promoter is provided herein as are examples of additional fatty acid-inducible promoters.

Alternatively, decreasing cytochrome P450 reductase activity in a cell can be accomplished by modifying the amount of cytochrome P450 reductase protein expression in the cell, for example, by replacing the wild-type promoter of an endogenous cytochrome P450 reductase gene in an organism with a weaker heterologous promoter, deleting or disrupting an endogenous gene, and/or replacing or modifying a gene encoding a wild-type cytochrome P450 reductase such that the encoded modified or substituted cytochrome P450 reductase protein has a reduced enzyme activity.

Modification of an Alcohol Dehydrogenase Activity

A second step in the ω-oxidation pathway generally is the conversion of a fatty alcohol to a corresponding fatty aldehyde and involves $NAD^+$- or $NADP^+$-dependent fatty alcohol dehydrogenases and/or hydrogen peroxide-producing fatty alcohol oxidases. Oxidation of the alcohol to an aldehyde may be performed by an enzyme in the fatty alcohol oxidase family (e.g., long-chain fatty alcohol oxidase EC 1.1.3.20), or an enzyme in the alcohol dehydrogenase family (e.g., fatty alcohol dehydrogenase; EC 1.1.1.1). An alcohol dehydrogenase (e.g., fatty alcohol dehydrogenase, long-chain alcohol dehydrogenase) can catalyze the removal of a hydrogen from an alcohol to yield an aldehyde or ketone and a hydrogen atom and NADH.

In some embodiments of the cells, organisms, compositions and methods provided herein, the amount and/or activity of an alcohol dehydrogenase in a cell is modified. For example, in some aspects, a cell or microorganism may be modified to increase the amount and/or activity of an alcohol dehydrogenase, may be modified to decrease the amount and/or activity of an alcohol dehydrogenase, or may be modified to alternately increase and decrease the amount and/or activity of an alcohol dehydrogenase depending, for example, on the cellular location(s) of the enzyme and/or on the conditions in which the modified cell or microorganism is cultured.

In certain aspects, the amount and/or activity of an alcohol dehydrogenase in a cell is increased. Increasing the amount and/or activity of an alcohol dehydrogenase may be particularly beneficial in embodiments in which the flux of carbons from fatty acids is directed toward a particular target product pathway involving oxidative metabolism and away from other cellular metabolic pathways not involved in target molecule production.

In certain embodiments, the alcohol dehydrogenase activity is unchanged in a host or engineered cell or organism. In one embodiment, the amount and/or activity of a host alcohol dehydrogenase can be increased, for example, by increasing the number of copies of a nucleic acid encoding an alcohol dehydrogenase (e.g., 1, 2, 3, 4, 5, 6, 7, 8, 9, 10, 15, 20, 25 or more copies of the nucleic acid), by increasing the activity of a promoter that regulates transcription of a nucleic acid encoding an alcohol dehydrogenase, or by increasing the number of copies of a nucleic acid encoding an alcohol dehydrogenase and increasing the activity of a promoter that regulates transcription of a nucleic acid encoding an alcohol dehydrogenase. In some embodiments, an alcohol dehydrogenase is endogenous to the host cell or microorganism. In one aspect of the cell or microbial systems and methods provided herein, the amount of alcohol dehydrogenase protein expressed in a cell can be increased by introducing heterologous nucleic acid encoding an alcohol dehydrogenase into a cell or microorganism. For example, introduction of heterologous nucleic acid encoding an alcohol dehydrogenase can result in increased copy number of such nucleic acids and/or provide for modification of the cellular location in which the protein is expressed.

In some embodiments, an alcohol dehydrogenase enzyme can be a yeast or bacterial protein. In a particular embodiment, the alcohol dehydrogenase enzyme can be a *Candida* (e.g., *C. tropicalis, C. viswanathii, C. maltosa, C. cloacae*), *Yarrowia* (e.g., *Y. lipolytica*) or *Bacillus* (*B. stearothermophilus*) protein. In a particular embodiment, the alcohol dehydrogenase enzyme can be a *Candida* yeast protein. *Candida tropicalis* contains at least 6 genes encoding alcohol dehydrogenases. Examples of *Candida viswanathii* nucleotide sequences encoding polypeptides having alcohol dehydrogenase activities are provided herein (nucleotide SEQ ID NO: 100 and amino acid SEQ ID NO: 46) and in International patent application no. PCT/US2012/045615 (publication no. WO 2013/106730). Additional examples of nucleotide sequences encoding polypeptides having alcohol dehydrogenase activity include, but are not limited to: *Candida tropicalis* ADH1 (Genbank accession no. XM_002546589), *Candida utilis* ADH1 (Genbank accession no. DQ397054), *Candida albicans* ADH1 (Genbank accession no. X81694), *Aspergillus flavus* ADH1 (Genbank accession no. L27434), *Yarrowia lipolytica* ADH1 (Genbank accession no. AF175271), *Yarrowia lipolytica* ADH2 (Genbank accession no. AF175272), *Yarrowia lipolytica* ADH3 (Genbank accession no. AF175273), *Bacillus stearothermophilus* ADH-HT (Genbank accession no. Z27089), *Pseudomonas putida* ADHA (Genbank accession no. AF052750).

Presence, absence or amount of alcohol dehydrogenase activity can be detected by any suitable method known in the art. For example, detection can be performed using spectrophotometric assays (see, e.g., Gatter et al. (2014) *FEMS Yeast Res.* 14:858-872). Nucleic acid sequences encoding native and/or modified alcohol dehydrogenase also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits decreased RNA and/or polypeptide levels as compared to the host cell or organism.

The promoter used for regulating transcription of a heterologous nucleic acid encoding an alcohol dehydrogenase can also be modified. For example, the amount of an alcohol dehydrogenase protein expressed in a particular cellular location may be increased by including in the heterologous nucleic acid a strong heterologous promoter and/or a promoter that provides for a different pattern of expression in the cell or microorganism. An example of one such heterologous promoter is a *Candida* hydratase-dehydrogenase-epimerase (HDE) gene promoter. The nucleotide sequence of a *Candida viswanathii* HDE gene promoter is provided herein as are examples of additional fatty acid-inducible promoters.

Alternatively, decreasing alcohol dehydrogenase activity in a cell can be accomplished by modifying the amount of alcohol dehydrogenase protein expression in the cell, for example, by replacing the wild-type promoter of an endogenous alcohol dehydrogenase gene in an organism with a weaker heterologous promoter, deleting or disrupting an endogenous gene, and/or replacing or modifying a gene encoding a wild-type alcohol dehydrogenase such that the encoded modified or substituted alcohol dehydrogenase protein has a reduced enzyme activity.

Modification of Fatty Alcohol Oxidase Activity

A fatty alcohol oxidase (e.g., long-chain alcohol oxidase, EC 1.1.3.20) enzyme can catalyze the oxidation of a fatty alcohol to yield a fatty aldehyde in the peroxisome of a cell. In some embodiments of the cells, organisms, compositions and methods provided herein, the amount and/or activity of a fatty alcohol oxidase in a cell is modified. For example, in some aspects, a cell or microorganism may be modified to increase the amount and/or activity of a fatty alcohol oxidase, may be modified to decrease the amount and/or activity of a fatty alcohol oxidase, or may be modified to alternately increase and decrease the amount and/or activity of a fatty alcohol oxidase depending, for example, on the cellular location(s) of the enzyme and/or on the conditions in which the modified cell or microorganism is cultured.

In certain aspects, the amount and/or activity of a fatty alcohol oxidase in a cell is increased. Increasing the amount and/or activity of a fatty alcohol oxidase may be particularly beneficial in embodiments in which the flux of carbons from fatty acids is directed toward a particular target product pathway involving oxidative metabolism and away from other cellular metabolic pathways not involved in target molecule production.

In certain embodiments, the fatty alcohol oxidase activity is unchanged in a host or engineered cell or organism. In one embodiment, the amount and/or activity of a host fatty alcohol oxidase can be increased, for example, by increasing the number of copies of a nucleic acid encoding a fatty alcohol oxidase (e.g., 1, 2, 3, 4, 5, 6, 7, 8, 9, 10, 15, 20, 25 or more copies of the nucleic acid), by increasing the activity of a promoter that regulates transcription of a nucleic acid encoding a fatty alcohol oxidase, or by increasing the number of copies of a nucleic acid encoding a fatty alcohol oxidase and increasing the activity of a promoter that regulates transcription of a nucleic acid encoding a fatty alcohol oxidase. In some embodiments, a fatty alcohol oxidase is endogenous to the host cell or microorganism. In one aspect of the cell or microbial systems and methods provided herein, the amount of fatty alcohol oxidase protein expressed in a cell can be increased by introducing heterologous nucleic acid encoding a fatty alcohol oxidase into a cell or microorganism. For example, introduction of heterologous nucleic acid encoding a fatty alcohol oxidase can result in increased copy number of such nucleic acids and/or provide for modification of the cellular location in which the protein is expressed.

In some embodiments, a fatty alcohol oxidase enzyme can be a yeast or bacterial protein. In a particular embodiment, the fatty alcohol oxidase enzyme can be a *Candida* (e.g., *C. tropicalis, C. viswanathii, C. maltosa, C. cloacae*), *Yarrowia* (e.g., *Y. lipolytica*) or *Bacillus* (e.g., *B. stearothermophilus*) protein. In a particular embodiment, the fatty alcohol oxidase enzyme can be a *Candida* yeast protein. *Candida tropicalis* contains two genes encoding fatty alcohol oxidase. Examples of *Candida viswanathii* nucleotide sequences encoding polypeptides having fatty alcohol oxidase activities are provided herein (nucleotide SEQ ID NO: 101 and amino acid SEQ ID NO: 47) and in International patent application no. PCT/US2012/045615 (publication no. WO 2013/106730). Additional examples of nucleotide sequences encoding polypeptides having fatty alcohol oxidase activity include, but are not limited to: *Candida tropicalis* FAO1 (Genbank accession no. AY538780), *Candida tropicalis* FAO2a (Genbank accession no. AY538781), *Candida tropicalis* FAO2b (Genbank accession no. AY538782).

Presence, absence or amount of fatty alcohol oxidase activity can be detected by any suitable method known in the art. For example, detection can be performed using a two-enzyme coupled reaction assay (see, e.g., Eirich et al. (2004) *Appl. Environ. Microbiol.* 70(8):4872-4879). Nucleic acid sequences encoding native and/or modified fatty alcohol oxidase also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits decreased RNA and/or polypeptide levels as compared to the host cell or organism.

The promoter used for regulating transcription of a heterologous nucleic acid encoding a fatty alcohol oxidase protein expressed in a particular cellular location may be increased by including in the heterologous nucleic acid a strong heterologous promoter and/or a promoter that provides for a different pattern of expression in the cell or microorganism. An example of one such heterologous promoter is a *Candida* hydratase-dehydrogenase-epimerase (HDE) gene promoter. The nucleotide sequence of a *Candida viswanathii* HDE gene promoter is provided herein as are examples of additional fatty acid-inducible promoters.

Alternatively, decreasing fatty alcohol oxidase activity in a cell can be accomplished by modifying the amount of fatty alcohol oxidase protein expression in the cell, for example, by replacing the wild-type promoter of an endogenous fatty alcohol oxidase gene in an organism with a weaker heterologous promoter, deleting or disrupting an endogenous gene, and/or replacing or modifying a gene encoding a wild-type fatty alcohol oxidase such that the encoded modified or substituted fatty alcohol oxidase protein has a reduced enzyme activity.

Modification of Aldehyde Dehydrogenase Activity

A third step in the ω-oxidation pathway is generally the conversion of a fatty aldehyde to a corresponding fatty acid and involves $NAD^+$- or $NADP^+$-dependent fatty aldehyde dehydrogenases (e.g., long-chain-aldehyde dehydrogenase or fatty aldehyde dehydrogenase; EC 1.2.1.48). In some embodiments of the cells, organisms, compositions and methods provided herein, the amount and/or activity of a fatty aldehyde dehydrogenase in a cell is modified. For example, in some aspects, a cell or microorganism may be modified to increase the amount and/or activity of a fatty aldehyde dehydrogenase, may be modified to decrease the amount and/or activity of a fatty aldehyde dehydrogenase, or may be modified to alternately increase and decrease the amount and/or activity of a fatty aldehyde dehydrogenase depending, for example, on the cellular location(s) of the enzyme and/or on the conditions in which the modified cell or microorganism is cultured.

In certain aspects, the amount and/or activity of a fatty aldehyde dehydrogenase in a cell is increased. Increasing the amount and/or activity of a fatty aldehyde dehydrogenase may be particularly beneficial in embodiments in which the flux of carbons from fatty acids is directed toward a particular target product pathway involving oxidative metabolism and away from other cellular metabolic pathways not involved in target molecule production.

In certain embodiments, the fatty aldehyde dehydrogenase activity is unchanged in a host or engineered cell or organism. In one embodiment, the amount and/or activity of a host fatty aldehyde dehydrogenase can be increased, for example, by increasing the number of copies of a nucleic acid encoding a fatty aldehyde dehydrogenase (e.g., 1, 2, 3, 4, 5, 6, 7, 8, 9, 10, 15, 20, 25 or more copies of the nucleic acid), by increasing the activity of a promoter that regulates transcription of a nucleic acid encoding a fatty aldehyde dehydrogenase, or by increasing the number of copies of a nucleic acid encoding a fatty aldehyde dehydrogenase and increasing the activity of a promoter that regulates transcription of a nucleic acid encoding a fatty aldehyde dehydrogenase. In some embodiments, a fatty aldehyde dehydrogenase is endogenous to the host cell or microorganism. In one aspect of the cell or microbial systems and methods provided herein, the amount of fatty aldehyde dehydrogenase protein expressed in a cell can be increased by introducing heterologous nucleic acid encoding a fatty aldehyde dehydrogenase into a cell or microorganism. For example, introduction of heterologous nucleic acid encoding a fatty aldehyde dehydrogenase can result in increased copy number of such nucleic acids and/or provide for modification of the cellular location in which the protein is expressed.

In some embodiments, a fatty aldehyde dehydrogenase enzyme can be a yeast protein. In a particular embodiment, the fatty aldehyde dehydrogenase enzyme can be a *Candida* (e.g., *C. tropicalis, C. viswanathii, C. maltosa, C. cloacae*)

or a *Yarrowia* (e.g., *Y. lipolytica*) yeast protein. In a particular embodiment, the fatty aldehyde dehydrogenase enzyme can be a *Candida* yeast protein. Examples of *Candida viswanathii* nucleotide sequences encoding polypeptides having fatty aldehyde dehydrogenase activities are provided, for example, in International patent application no. PCT/US2012/045615 (publication no. WO 2013/106730). Additional examples of nucleotide sequences encoding polypeptides having fatty aldehyde dehydrogenase activity include, but are not limited to: *Yarrowia lipolytica* HFD1 (Genbank accession no. AB935099), *Yarrowia lipolytica* HFD2A (Genbank accession no. AB935101), *Yarrowia lipolytica* HFD2B (Genbank accession no. AB935103), *Yarrowia lipolytica* HFD3 (Genbank accession no. AB935104), *Yarrowia lipolytica* HFD4 (Genbank accession no. AB935106).

Presence, absence or amount of fatty aldehyde dehydrogenase activity can be detected by any suitable method known in the art. For example, detection can be performed using enzyme activity assays (see, e.g., Iwama et al. (2014) *J. Biol. Chem.* 289(48):33275-33286). Nucleic acid sequences encoding native and/or modified fatty aldehyde dehydrogenase also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cell or organism exhibits decreased RNA and/or polypeptide levels as compared to the host cell or organism.

The promoter used for regulating transcription of a heterologous nucleic acid encoding an fatty aldehyde dehydrogenase can also be modified. For example, the amount of a fatty aldehyde dehydrogenase protein expressed in a particular cellular location may be increased by including in the heterologous nucleic acid a strong heterologous promoter and/or a promoter that provides for a different pattern of expression in the cell or microorganism. An example of one such heterologous promoter is a *Candida* hydratase-dehydrogenase-epimerase (HDE) gene promoter. The nucleotide sequence of a *Candida viswanathii* HDE gene promoter is provided herein as are examples of additional fatty acid-inducible promoters.

Alternatively, decreasing fatty aldehyde dehydrogenase activity in a cell can be accomplished by modifying the amount of fatty aldehyde dehydrogenase protein expression in the cell, for example, by replacing the wild-type promoter of an endogenous fatty aldehyde dehydrogenase gene in an organism with a weaker heterologous promoter, deleting or disrupting an endogenous gene, and/or replacing or modifying a gene encoding a wild-type fatty aldehyde dehydrogenase such that the encoded modified or substituted fatty aldehyde dehydrogenase protein has a reduced enzyme activity.

Modification of β-Oxidation

Another oxidative metabolism pathway, referred to as β-oxidation, is generally a degradative pathway through which fatty acids, typically in the form of fatty acid-CoA esters, can be broken down to shorter chain acyl-CoA and acetyl-CoA. In fungi and plant cells, β-oxidation can occur in peroxisomes, whereas in animal cells it additionally can take place in mitochondria. The β-oxidation pathway generally includes four main reaction steps resulting in an acyl-CoA that is shortened by two carbon atoms which are released as acetyl-CoA. The shortened acyl-CoA molecule can re-enter the pathway after each cycle and be subjected to another removal of two carbons from the acyl carbon chain. As such, the β-oxidation pathway can generate significant amounts of acetyl-CoA and is a major source of acetyl-CoA in cells. Alteration of enzyme activities in the the β-oxidation pathway can also provide for the generation of fatty acid or diacid target molecules including, but not limited to, adipic acid, suberic acid, sebacic acid and dodecanedioic acid (DDDA). Provided herein are cells, organisms, compositions and methods in which cellular carbon flux has been modified through one or more alterations in the β-oxidation pathway. In some embodiments, the β-oxidation pathway is modified by modifying one or more activities in the pathway. In particular embodiments, the β-oxidation pathway is modified to increase the generation of acetyl-CoA in a cell for use in target molecule production. For example, the β-oxidation pathway can be modified to increase one or more activities in the pathway. In some embodiments, β-oxidation can be manipulated (e.g., decreasing one or more pathway activities and/or altering the specificity of one or more activities) to be used as a pathway for production of target fatty acids and diacids (e.g., adipic acid) of a particular carbon chain length.

The term "β-oxidation pathway" as used herein, refers to a series of cellular enzymatic activities utilized to metabolize fatty alcohols, fatty acids, or dicarboxylic acids. The activities utilized to metabolize fatty alcohols, fatty acids, or dicarboxylic acids can include, but are not limited to, acyl-CoA oxidase activity, acyl-CoA hydrolase activity, enoyl-CoA hydratase activity, 3-hydroxyacyl-CoA dehydrogenase activity, and acetyl-CoA C-acyltransferase activity. The term "β-oxidation activity" refers to any and/or all of the activities in the β-oxidation pathway utilized to metabolize fatty alcohols, fatty acids or dicarboxylic acids. Additional activities, referred to as β-oxidation peripheral or auxiliary activities, can be involved in degradation of unsaturated fatty acids (i.e., fatty acid chains containing double bonds) and fatty acids containing modifications (e.g., hydroxyl, methyl, phenoxy groups) including, but not limited to enoyl CoA isomerase ((ECI) or enoyl-CoA delta isomerase 1, dodecenoyl-CoA isomerase, 3,2 trans-enoyl-CoA isomerase, acetylene-allene isomerase, delta3, delta2-enoyl-CoA isomerase, dodecenoyl-CoA delta isomerase, and EC 5.3.3.8), dienoyl CoA Isomerase (DCI, e.g., EC 5.3.3, Δ3,5,Δ2,4-dienoyl-CoA isomerase, Δ3,5,Δ2,4-dienoyl-coenzyme A isomerase) and 2,4-dienoyl-CoA reductase (DCR, e.g., EC 1.3.1.34).

There are also cellular compositions and activities that can be closely associated with β-oxidation. These include peroxisomal- and mitochondrial-related compositions and activities. For example, as described herein, such compositions and activities include, but are not limited to, acyl-CoA synthetases, thioesterases, peroxisomal transport proteins and peroxisomal biogenesis factors. Included in the cells, organisms, systems and methods provided herein are embodiments in which one or more of these β-oxidation-associated compositions and/or activities are modified. In some embodiments, a β-oxidation-associated composition or activity is modified to enhance β-oxidation activity.

Modification of Acyl-CoA Oxidase Activity

Typically, the first step in the β-oxidation pathway is oxidation of acyl-CoA, which is carried out by the enzyme acyl-CoA oxidase (e.g., EC 1.3.3.6). This step can be a rate-limiting step in β-oxidation. The term "acyl-CoA oxidase activity" as used herein refers to the enzymatic activity (e.g., catalytic activity) of an acyl-CoA oxidase. An acyl-CoA oxidase can catalyze the following chemical reaction:

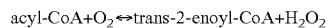

acyl-CoA+O$_2$↔trans-2-enoyl-CoA+H$_2$O$_2$

Acyl-CoA oxidase enzymes generally contain FAD from which two electrons are transferred to oxygen to generate $H_2O_2$.

Different cells contain different types, and numbers of types, of acyl-CoA oxidase activities. For example, *Saccharomyces cerevisiae* expresses only one acyl-CoA oxidase, Pox1p/Fox1p, which has activity on acyl-CoA substrates with a broad range of carbon chain lengths. In contrast, other organisms, e.g., species of *Candida, Yarrowia, Arabidopsis*, can have multiple genes encoding different proteins having acyl-CoA oxidase activities with varying substrate specificities. In some embodiments, acyl-CoA oxidase activity refers to its enzyme activity (or lack thereof) on a selective set of substrates. The activity of an acyl-CoA oxidase can be affected by its ability to bind a substrate, oxidize a substrate and/or release a product. In some embodiments, an acyl-CoA oxidase is active in one compartment of a cell and not in another compartment of the cell. In some embodiments, an acyl-CoA oxidase activity is from a peroxisome.

Different Acyl-CoA oxidases can display different carbon chain-length substrate specificities. Some acyl-CoA oxidases display broad chain-length specificity and can accept any fatty acyl-CoA (or diacyl-CoA) as a substrate. However, some acyl-CoA oxidases can display narrow chain-length specificity. For example, the acyl-CoA oxidase activity encoded by the POX4 gene of *Candida* strain ATCC 20336 has a relatively broad carbon chain-length specificity and exhibits a higher specific activity for acyl-CoA molecules with shorter carbon chain lengths (e.g., less than 10 carbons). The Pox5 enzyme from *Candida* strain ATCC 20336 displays optimal activity on fatty acid substrates having 12 to 18 carbons (C12-C18) in the carbon chain, a decreased activity on substrates having less than 10 carbons (C10) in the carbon chain and has low activity on C6 and C8 substrates. In a cell with such a *Candida* Pox5 as the only functional acyl-CoA oxidase, long chain fatty acyl-CoA or diacyl-CoA substrates can be shortened to about 8 carbons and do not typically enter another cycle of β-oxidation. The shorter substrates (e.g., a C8 fatty acid or dicarboxylic acid) are not typically recognized as a substrate by Pox5. In this instance, an acyl-CoA would not be completely broken down to acetyl-CoA units. Instead, the chain-length substrate specificity of the acyl-CoA oxidase in such a cell (which would limit further degradation of an acyl-CoA once it has been broken down into about an 8-carbon chain) effectively controls the chain length of an acid or diacid produced through break down of fatty acids through β-oxidation. The shorter substrates (e.g., a C8 acyl-CoA) would remain intact, the CoA would be removed by peroxisomal thioesterases and the fatty acid or dicarboxylic acid (e.g., an α,ω-dicarboxylic acid) product is secreted from the cell. In this way, β-oxidation can be manipulated to be used as a pathway for production of target fatty acids and diacids (e.g., adipic acid) of a particular carbon chain length.

In some embodiments of the cells, organisms, compositions and methods provided herein, the amount and/or activity of one or more acyl-CoA oxidases in a cell is modified. For example, in some aspects, a cell or microorganism may be modified to increase the amount and/or activity of an acyl-CoA oxidase, may be modified to decrease the amount and/or activity of an acyl-CoA oxidase, or may be modified to alternately increase and decrease the amount and/or activity of one or more acyl-CoA oxidases depending, for example, on the substrate specificity, target molecule(s) being produced, cellular location(s) of the enzyme and/or on the conditions in which the modified cell or microorganism is cultured.

In certain aspects, the amount and/or activity of an acyl-CoA oxidase in a cell is increased. Increasing the amount and/or activity of an acyl-CoA oxidase may be particularly beneficial in embodiments in which the flux of carbons from fatty acids is directed toward a particular target product pathway involving oxidative metabolism and away from other cellular metabolic pathways not involved in target molecule production.

In certain embodiments, the acyl-CoA oxidase activity is unchanged in a host or engineered cell or organism. In one embodiment, the amount and/or activity of a host acyl-CoA oxidase can be increased, for example, by increasing the number of copies of a nucleic acid encoding an acyl-CoA oxidase (e.g., 1, 2, 3, 4, 5, 6, 7, 8, 9, 10, 15, 20, 25 or more copies of the nucleic acid), by increasing the activity of a promoter that regulates transcription of a nucleic acid encoding an acyl-CoA oxidase, or by increasing the number of copies of a nucleic acid encoding an acyl-CoA oxidase and increasing the activity of a promoter that regulates transcription of a nucleic acid encoding an acyl-CoA oxidase. In some embodiments, an acyl-CoA oxidase is endogenous to the host cell or microorganism. In one aspect of the cell or microbial systems and methods provided herein, the amount of an acyl-CoA oxidase protein expressed in a cell can be increased by introducing heterologous nucleic acid encoding an acyl-CoA oxidase into a cell or microorganism. For example, introduction of heterologous nucleic acid encoding an acyl-CoA oxidase can result in increased copy number of such nucleic acids and/or provide for modification of the cellular location in which the protein is expressed.

Non-limiting examples of organisms that include, or can be used as donors for, an acyl-CoA oxidase enzyme include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*). In a particular embodiment, an acyl-CoA oxidase enzyme can be a *Candida* yeast protein. Examples of *Candida viswanathii* nucleotide sequences encoding acyl-CoA oxidases are provided herein (nucleotide SEQ ID NOS: 92 and 93 and amino acid SEQ ID NOS: 36, 37, 38 and 39) and in International patent application no. PCT/US2012/045622 (publication no. WO 2013/006733) and International patent application no. PCT/US2013/076739 (publication no. WO 2014/100504). Additional examples of nucleotide sequences encoding polypeptides having acyl-CoA oxidase activity include: *Saccharomyces cerevisiae* POX1 (Genbank accession no. M27515), *Candida albicans* POX1-3 (Genbank accession no. XM_716636), *Candida tropicalis* POX2 (Genbank accession no. XM_002548031), *Candida tropicalis* POX5 (Genbank accession no. XM_002548378), *Candida tropicalis* POX4 (Genbank accession nos. AB031271, AB031272), *Candida maltosa* POX2 (Genbank accession no. D21228), *Yarrowia lipolytica* ACO1 (Genbank accession no. AJ001299), *Yarrowia lipolytica* ACO2 (Genbank accession no. A001300), *Yarrowia lipolytica* ACO3 (Genbank accession no. AJ001301), *Yarrowia lipolytica* ACO4 (Genbank accession no. AJ001302), *Yarrowia lipolytica* ACO5 (Genbank accession no. AJ001303), *Debaryomyces fabyri* (Genbank accession no. XM_015613952).

Presence, absence or amount of acyl-CoA oxidase activity can be detected by any suitable method known in the art and/or described herein. For example, detection can be performed using enzyme activity assays (see, e.g., Shimizu et al. (1979) *Biochem. Biophys. Res. Commun.* 91:108-113;

Yao et al. (2014) *J. Braz. Chem. Soc.* 25(4):777-782); Kvannes and Flatmark (1991) *J. Biochem. Biophys. Methods* 23(2):135-149). Native and/or disrupted nucleic acid sequences encoding acyl-CoA oxidase (or other polypeptide) also can be detected using nucleic acid detection methods (e.g., PCR, primer extension, nucleic acid hybridization, the like and combinations thereof), and the amount of the nucleic acids or encoded proteins can be assessed using quantitative expression based analysis (e.g., RT-PCR, western blot analysis, northern blot analysis, the like and combinations thereof), where the engineered cells or organisms exhibit increased or decreased RNA and/or polypeptide levels as compared to the host cell or organism.

The promoter used for regulating transcription of a heterologous nucleic acid encoding an acyl-CoA oxidase can also be modified. For example, the amount of an acyl-CoA oxidase protein expressed in a particular cellular location may be increased by including in the heterologous nucleic acid a strong heterologous promoter and/or a promoter that provides for a different pattern of expression in the cell or microorganism. An example of one such heterologous promoter is a *Candida* hydratase-dehydrogenase-epimerase (HDE) gene promoter. The nucleotide sequence of a *Candida viswanathii* HDE gene promoter is provided herein as are examples of additional fatty acid-inducible promoters.

Alternatively, decreasing acyl-CoA oxidase activity in a cell can be accomplished by modifying the amount of acyl-CoA oxidase protein expression in the cell, for example, by replacing the wild-type promoter of an endogenous acyl-CoA oxidase gene in an organism with a weaker heterologous promoter, deleting or disrupting an endogenous gene, and/or replacing or modifying a gene encoding a wild-type acyl-CoA oxidase such that the encoded modified or substituted acyl-CoA oxidase protein has a reduced enzyme activity. Reducing or eliminating the amount and/or activity of an acyl-CoA oxidase may be particularly beneficial in embodiments in which a target molecule and/or precursor or intermediate in the production of a target molecule contains a carbon chain of a particular length. In this case, the processing of fatty acids of particular chain lengths may be decreased or eliminated by decreasing the amount and/or activity of a particular acyl-CoA oxidase having activity on fatty acids of the particular chain length in a cell. Certain aspects of the cells, microorganisms, compositions and methods provided herein include one or more modifications to reduce or eliminate an acyl-CoA oxidase. One approach to reducing or eliminating the amount and/or activity of an acyl-CoA oxidase is by disrupting or deleting nucleic acid encoding the acyl-CoA oxidase in a host cell or microorganism to reduce or eliminate the acyl-CoA oxidase activity in the host relative to a cell or microorganism in which the gene(s) have not been modified. For example, expression of a host acyl-CoA oxidase activity can be decreased or eliminated by disruption (e.g., knockout, insertion mutagenesis, the like and combinations thereof) of a host gene encoding the protein, or by decreasing the activity of the promoter (e.g., through addition of repressor sequences to the promoter or 5'UTR or replacing the promoter) that controls transcription of an acyl-CoA oxidase gene using recombinant molecular biology techniques known in the art and/or described herein.

One method for disrupting an endogenous acyl-CoA oxidase gene is by recombinantly inserting a heterologous nucleic acid (e.g., a nucleotide sequence encoding a selectable marker such as an enzyme that restores an auxotrophic host organism to prototrophy) into the endogenous gene, thereby generating an engineered organism deficient in acyl-CoA oxidase activity. This can be done, for example, through homologous recombination in which a heterologous nucleic acid containing sequences of an endogenous acyl-CoA oxidase gene and a disrupting sequence (e.g., a knockout gene cassette such as described herein) is introduced into a host cell or microorganism. In some embodiments, the nucleotide sequence of one or more acyl CoA oxidases (e.g., a yeast POX4, POX5, or POX4 and POX5) can be disrupted with a URA3 nucleotide sequence encoding a selectable marker, and introduced to a host cell or microorganism, thereby generating an engineered cell or organism deficient in an acyl-CoA oxidase activity. Nucleic acids encoding an acyl-CoA oxidase can be obtained from a number of sources, including, for example, yeast cells. Genomic DNA from cell sources can be amplified using oligonucleotide primers based on the nucleotide sequence of an acyl-CoA oxidase encoding gene, including examples provided herein.

In some embodiments, of the cells, organisms, compositions and methods provided herein, the amount and/or activity of a peroxisomal acyl-CoA oxidase in a cell is modified, e.g., a POX activity of a POX polypeptide. In particular embodiments, the acyl-CoA oxidase activity to be modified is encoded by the POX4 and/or POX5 genes of a species of *Candida* (e.g., ATCC 20336). In certain embodiments, the amount and/or activity of an endogenous acyl-CoA oxidase can be increased. In some embodiments, the amount and/or activity of acyl-CoA oxidases in a cell or organism containing one or more acyl-CoA oxidases can be independently modified (e.g., one or more acyl-CoA oxidases can be modified). In some embodiments, the amount and/or activity of POX4 acyl-CoA oxidase and a POX5 acyl-CoA oxidase can be altered independently of each other (e.g., increase amount and/or activity of POX4 alone, POX5 alone, increase amount and/or activity of one and decrease or eliminate the amount and/or activity of the other, and the like). Increasing the amount and/or activity of one acyl-CoA oxidase, while decreasing or eliminating the amount and/or activity of another acyl-CoA oxidase, may alter the specific activity of acyl-CoA oxidase in a cell or organism with respect to carbon chain length, while maintaining or increasing overall carbon flux through the β-oxidation pathway, in certain embodiments. Disruption of nucleotide sequences encoding one or more acyl-CoA oxidases (e.g., POX4, POX 5, or POX4 and POX5) sometimes can alter pathway efficiency, specificity and/or specific activity with respect to metabolism of carbon chains of different lengths (e.g., carbon chains including fatty alcohols, fatty acids, paraffins, dicarboxylic acids, aliphatic molecules of between about 1 and about 26 carbons in length).

In some embodiments of the modified cells or organisms provided herein, a β-oxidation pathway in a yeast is active and includes a genetically modified acyl-CoA oxidase. In some embodiments, an acyl-CoA oxidase is genetically modified to prevent complete oxidation of fatty acyl-CoA or diacyl-CoA substrates. Genetic modification of an acyl-CoA oxidase can increase the production yield of a desired fatty acid or fatty dicarboxylic acid product. Therefore, in some embodiments, metabolic degradation of a fatty acid of a specified chain length (e.g., the chain length of a desired or target fatty acid or fatty dicarboxylic acid product) is reduced significantly, when an acyl-CoA oxidase is genetically modified. For example, metabolic degradation of a fatty dicarboxylic acid product (e.g., dodecanedioic acid or DDDA) by beta-oxidation can be reduced significantly when an acyl-CoA oxidase is genetically modified. This can be accomplished by modifying the substrate specificity of an acyl-CoA oxidase such that the enzyme has low activity (e.g., enzymatic activity) on chain lengths equal to or less than that of a desired product.

Nucleic acids encoding a genetically modified acyl-CoA oxidase can be engineered and expressed in a suitable organism (e.g., bacteria (e.g., *E. coli*) or a yeast) to test the substrate specificity of the modified enzyme in vitro. In some embodiments, nucleic acids encoding a genetically modified acyl-CoA oxidase are engineered and expressed in a suitable yeast and the substrate specificity is tested. Yeast that express a modified acyl-CoA oxidase can be tested for production of a desired molecule, e.g., a fatty acid or fatty dicarboxylic acid product. A modified acyl-CoA oxidase can be generated in any suitable manner (e.g., random or rational mutagenesis), non-limiting examples of which are provided herein and, for example, in International patent application no. PCT/US2012/045622 (publication no. WO 2013/006733) and International patent application no. PCT/US2013/076739 (publication no. WO 2014/100504).

In some instances, a modified endogenous acyl-coA oxidase polypeptide is a modified POX4 or POX5 polypeptide from a *Candida* spp. yeast (e.g., strain ATCC 20336 or ATCC 20962). In some cases a modified POX4 polypeptide contains a modified amino acid sequence of the wild-type *Candida* strain ATCC 20336 Pox4p sequence provided herein. Sometimes the POX4 polypeptide contains an amino acid modification at one or more amino acid positions chosen from 88, 90, 96, 98, 99, 100, 102, 103, 302, 309, 310, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504 and 505. A modified endogenous acyl-coA oxidase polypeptide that is not a modified POX4 polypeptide can include an amino acid modification at one or more positions corresponding to one or more of the foregoing positions in the POX4 polypeptide. In some instances a modified POX5 polypeptide contains a modified amino acid sequence of the wild-type *Candida* strain ATCC 20336 Pox5p sequence provided herein. Sometimes the POX5 polypeptide contains an amino acid modification at one or more amino acid positions chosen from 81, 82, 83, 84, 85, 86, 88, 93, 94, 95, 96, 98, 102, 284, 287, 290, 291, 292, 294, 295, 436, 453, 454, 455, 456, 457, 458, 459, 460, 461, 462 and 463. A modified endogenous acyl-coA oxidase polypeptide that is not a modified POX5 polypeptide can include an amino acid modification at one or more positions corresponding to one or more of the foregoing positions in the POX5 polypeptide.

In some embodiments, the substrate specificity of an acyl-CoA oxidase is modified such that the enzyme has low activity for aliphatic molecules with chain lengths less than C24 (i.e., 24 carbons). In some embodiments, the substrate specificity of an acyl CoA oxidase is modified such that the enzyme has very low activity with chain lengths less than 24, 22, 20, 18, 16, 14, 12, 10, 8, 6 or 4 carbons. In some embodiments, the substrate specificity of an acyl-CoA oxidase is modified such that the enzyme has very low activity with chain lengths less than 18, 16, 14, 12, 10 or 8 carbons. In some embodiments, the substrate specificity of an acyl-CoA oxidase is modified such that the enzyme has very low activity with chain lengths less than C12. In some embodiments, the substrate specificity of an acyl-CoA oxidase is modified such that the enzyme has very low activity with chain lengths less than C10 or C8. For example, in one embodiment for producing a 6-carbon dicarboxylic acid (e.g., adipic acid), a host cell or organism can be modified to decrease or eliminate acyl-CoA oxidase activities that are active on a broad range of substrate chain lengths (e.g., Pox4p acyl-CoA oxidase of *Candida viswanathii* ATCC 20336), and, to further increase productivity, can additionally be modified to express a mutant acyl-CoA oxidase activity that is more active on substrates with chain lengths of C8 and greater with little or no activity on substrates with chain lengths less than C8 (e.g., *Candida viswanathii* ATCC 20336 Pox5p(F98G); SEQ ID NO: 37).

As described herein (and in International patent application no. PCT/US2012/045622 (publication no. WO 2013/006733) and International patent application no. PCT/US2013/076739 (publication no. WO 2014/100504)), catalytic specificity of acyl-CoA oxidases (e.g., POX4, POX5) can be altered by a variety of methods. Altering the binding and/or catalytic specificity of acyl-CoA oxidases may prove advantageous for generating novel acyl-CoA oxidases with altered chain length recognition, altered chain length catalytic activity, and/or generation of an acyl-CoA oxidase activity with a narrow or specific chain length specificity, thereby allowing further increases in pathway efficiency, specificity and/or specific activity with respect to metabolism of carbon chains of different lengths or metabolism of carbon chain distributions found in a particular chosen feedstock. In some embodiments the altered acyl-CoA oxidase sequences are identified and/or generated by; (i) screening naturally occurring variant populations; (ii) mutagenesis of endogenous sequences; (iii) introduction of heterologous sequences having a desired specificity; (iv) generation of chimeric sequences having a portion of the coding sequence from one polynucleotide source (e.g., gene, organism) and a portion of the coding sequence from another source and/or (v) intelligent design using nucleotide sequences and three dimensional structure analysis from an acyl-CoA oxidase having a desired specificity to remodel an endogenous acyl-CoA oxidase, thereby generating a novel specificity enzyme. In some embodiments, a chimeric acyl-CoA oxidase nucleic acid sequence can have polynucleotide sequence contributions from two or more sources. In some embodiments, a chimeric acyl-CoA oxidase nucleic acid sequence comprises a portion of the coding sequences from an endogenous polynucleotide and a portion of the coding sequence from a heterologous polynucleotide.

One method for generating modified acyl-CoA oxidase proteins having altered substrate specificity is through random mutagenesis. A library of genetically modified acyl-CoA oxidases can be generated using several methods known in the art (e.g., site-directed mutagenesis). Genetically modified acyl-CoA oxidase genes can then be transformed into a β-oxidation blocked strain of a suitable yeast strain (e.g., *Candida* spp. (e.g., *Candida viswanathii* or *Candida tropicalis*)). In some embodiments, a genetically modified acyl-CoA oxidase is expressed under the control of the POX4 promoter or another strong constitutive or inducible promoter in a pox4Δ/pox4Δ pox5Δ/pox5Δ (e.g., an organism that lacks some or all endogenous acyl-CoA oxidase activity) background. In some embodiments, the genetically modified acyl-CoA oxidase is expressed under the control of an endogenous promoter. In some embodiments, the genetically modified acyl-CoA oxidase is expressed under the control of a heterologous promoter. The transformants can be selected by growth in media containing a fatty acid or methyl-derivate fatty acid containing fatty acids with two more carbons than a fatty acid product of interest. For example, for an adipic acid product, the transformants can be grown in caprylic acid or methyl-caprylate. For example, for a dodecanedioic acid product, the transformants can be grown in tetradecanedioic acid. The group of transformants can then be moved to a medium with a carbon source of a fatty acid of interest (for example dodecanedioic acid) in the presence of an agent that kills growing cells (e.g., Nystatin) and cells that cannot metabolize the carbon source (e.g., dodecanedioic acid in this example) can be selected. The resulting modified strains can then be further characterized for acyl-CoA oxidase activity. This method can be used to select for any modified acyl CoA oxidase (e.g., those listed and/or described in International patent application no. PCT/US2012/045622 (publication no. WO 2013/006733) and International patent application no. PCT/US2013/076739 (publication no. WO 2014/100504)). In addition, this method can be used to select for any heterologous acyl-CoA oxidase expressed in a suitable organism.

Another method for generating modified acyl-CoA oxidase proteins having altered substrate specificity is through rational mutagenesis. Structural and sequence information and experimental data can be combined to determine specific mutations for testing in an acyl-CoA oxidase for altered specificity. For example, primary sequences of acyl-CoA oxidases tested can be compared and correlated with substrate specificity. Based on such an analysis, single amino-acids, small numbers of contiguous amino acids and/or domains can be proposed for providing a desired substrate specificity. Those amino acids positions can be targeted for specific or random mutations for improve specificity.

Acyl-CoA oxidase structure also can be modeled against a known tertiary structure using modeling methods known in the art. The models can be used to propose amino acids and regions pertaining to substrate selectivity. For example, biochemical, structure and sequence data suggest that the N-terminus of acyl-CoA oxidases often, in part, determines substrate specificity. Mutations or region replacements can be introduced based on such analyses and the specificity of the new acyl-CoA oxidase tested as described before. The resulting information can be used to go back to the models to postulate new potential mutations. As for random mutagenesis, any suitable acyl-CoA oxidase can be modified to alter substrate specificity (e.g., those listed in International patent application no. PCT/US2012/045622 (publication no. WO 2013/006733) and International patent application no. PCT/US2013/076739 (publication no. WO 2014/100504)).

Examples of modified Pox5 enzymes encoded by mutated POX5 genes from *Candida viswanathii* include Pox5p (F98G) and Pox5p(W249F) are provided herein. The design, generation and analysis of modified Pox5 enzymes encoded by mutated POX5 genes from *Candida viswanathii* are described in the examples.

Modification of Multifunctional Enzyme Activities

Next (e.g., second and third) steps of the β-oxidation pathway can be catalyzed by a multifunctional enzyme (referred to, for example, as Mfe2, Fox2 and HDE in fungi) having hydratase and dehydrogenase activities, or by separate hydratase and dehydrogenase enzymes. In these steps, a trans-2-enoyl-CoA can be converted to 3-ketoacyl-CoA via a (3R)-hydroxy intermediate. An enoyl-CoA hydratase enzyme (e.g., EC 4.2.1.17) can catalyze the addition of a hydroxyl group and a proton to the unsaturated β-carbon on a fatty-acyl CoA in a second step of the pathway to generate 3-hydroxyacyl-CoA. In a next (e.g., third) step, a 3-hydroxyacyl-CoA dehydrogenase enzyme (e.g., EC 1.1.1.35) can catalyze the formation of a 3-ketoacyl-CoA by removal of a hydrogen from the newly formed hydroxyl group created by the activity of an enoyl-CoA hydratase. Typically, fungi have one peroxisomal multifunctional enzyme (HDE, Mfe2 or Fox2), mammalian cells have two peroxisomal multifunctional enzymes (Mfe1 and Mfe2) and bacteria have a single multifunctional enzyme, Mfe1. In the yeast *Candida tropicalis*, the N-terminal portion of the MFE polypeptide typically contains two duplicate 3-hydroxyacyl-CoA dehydrogenase domains, referred to as the A and B domains, which have differing substrate specificities. The A domain can catalyze the reaction for substrates with medium-to-long carbon chains (e.g., C10-C16). The catalytic activity of the B domain often is more active on substrates having shorter carbon chains (e.g., C4). The hydratase domain is generally located at the C-terminal region of the polypeptide. Thus, each Mfe2 monomer can contain a dehydrogenase heterodimer and a hydratase monomer.

Some multifunctional enzymes involved in the β-oxidation pathway have additional enzymatic activities, including, but not limited to, an isomerase (e.g., a Δ3,Δ2-enoyl-CoA isomerase) activity and/or an epimerase (e.g., 3-hydroxyacyl-CoA epimerase; EC 5.1.2.3) activity. These enzymes function as auxiliary enzymes in the oxidation of polyunsaturated fatty acids. For example, 3-hydroxyacyl-CoA epimerase catalyzes the reversible conversion of S-3-hydroxyacyl-CoA to R-3-hydroxyacyl-CoA, which (unlike S-3-hydroxyacyl-CoA) is a substrate for 3-hydroxyacyl-CoA dehydrogenase contained within Mfe2-type enzymes. Therefore, β-oxidation can proceed through the third step once the R isomer has been generated.

In some embodiments of the cells, organisms, compositions and methods provided herein, the amount and/or activity of a multifunctional enzyme (or an enoyl-CoA hydratase or 3-hydroxyacyl-CoA dehydrogenase) in a cell is modified. In particular embodiments, the multifunctional enzyme is a peroxisomal protein. For example, in some aspects, a cell or microorganism may be modified to increase the amount and/or activity of a multifunctional enzyme (or an enoyl-CoA hydratase or 3-hydroxyacyl-CoA dehydrogenase), may be modified to decrease the amount and/or activity of a multifunctional enzyme (or an enoyl-CoA hydratase or 3-hydroxyacyl-CoA dehydrogenase), or may be modified to alternately increase and decrease the amount and/or activity of a multifunctional enzyme (or an enoyl-CoA hydratase or 3-hydroxyacyl-CoA dehydrogenase) depending, for example, on the substrate specificity, target molecule(s) being produced, cellular location(s) of the enzyme and/or on the conditions in which the modified cell or microorganism is cultured. In some embodiments, the amount and/or activity of one or more of the hydratase and dehydrogenase enzymes of a multifunctional enzyme may be independently modified.

In certain aspects, the amount and/or activity of one or more of the hydratase and dehydrogenase enzymes of a multifunctional enzyme in a cell is increased. Increasing the amount and/or activity of one or more of the hydratase and dehydrogenase enzymes of a multifunctional enzyme may be particularly beneficial in embodiments in which the flux of carbons from fatty acids is directed toward a particular target product pathway involving oxidative metabolism and away from other cellular metabolic pathways not involved in target molecule production.

In certain embodiments, the multifunctional enzyme (or an enoyl-CoA hydratase or 3-hydroxyacyl-CoA dehydrogenase) activity is unchanged in a host or engineered cell or organism. In one embodiment, the amount and/or activity of one or more of a hydratase and/or dehydrogenase enzyme, for example, of a multifunctional enzyme, can be increased, for example, by increasing the number of copies of a nucleic acid encoding one or more of a hydratase and/or dehydrogenase enzyme (for example, of a multifunctional enzyme) (e.g., 1, 2, 3, 4, 5, 6, 7, 8, 9, 10, 15, 20, 25 or more copies of the nucleic acid), by increasing the activity of a promoter that regulates transcription of a nucleic acid encoding one or more of a hydratase and dehydrogenase enzyme (for example, of a multifunctional enzyme), or by increasing the number of copies of a nucleic acid encoding one or more of a hydratase and/or dehydrogenase enzyme (for example, of a multifunctional enzyme) and increasing the activity of a promoter that regulates transcription of a nucleic acid encoding one or more of a hydratase and/or dehydrogenase enzyme (for example, of a multifunctional enzyme). In some embodiments, a multifunctional enzyme (or an enoyl-CoA hydratase and/or 3-hydroxyacyl-CoA dehydrogenase) is endogenous to the host cell or microorganism. In one aspect of the cell or microbial systems and methods provided herein, the amount of one or more of the hydratase and dehydrogenase enzymes of a multifunctional enzyme protein expressed in a cell can be increased by introducing heterologous nucleic acid encoding one or more of the hydratase and dehydrogenase enzymes of a multifunctional enzyme into a cell or microorganism. For example, introduction of heterologous nucleic acid encoding one or more of the hydratase and dehydrogenase enzymes of a multifunctional enzyme can result in increased copy number of such nucleic acids and/or provide for modification of the cellular location in which the protein is expressed.

Non-limiting examples of organisms that include, or can be used as donors for, one or more of the hydratase and dehydrogenase enzymes of a multifunctional enzyme include yeast (e.g., *Candida, Saccharomyces, Yarrowia*), animals (e.g., *Homo, Rattus*), bacteria. In a particular embodiment, one or more of the hydratase and dehydrogenase enzymes of a multifunctional enzyme can be a *Candida* yeast protein. Additional examples of nucleotide sequences encoding multifunctional enzyme polypeptides include: *Saccharomyces cerevisiae* FOX2 (Genbank accession nos. NM_001179799, M86456), *Candida tropicalis* (strain PK 233) HDE (Genbank accession nos. X57854, M22765), *Yarrowia lipolytica* MFE2 (Genbank accession no. AF198225).

Presence, absence or amount of one or more of the hydratase and dehydrogenase enzymes of a multifunctional enzyme can be detected by any suitable method known in the art and/or described herein. For example, detection can be performed using enzyme activity assays (see, e.g., Hiltunen et al. (1992) *J. Biol. Chem.* 267(10):6646-6653). Nucleic acid sequences representing native and/or modified multifunctional enzyme sequences also can be detected using nucleic acid detection methods (e.g., PCR, primer extension, nucleic acid hybridization, the like and combinations thereof), or the amounts of the nucleic acids or encoded proteins can be assessed using quantitative expression based analysis (e.g., RT-PCR, western blot analysis, northern blot analysis, the like and combinations thereof), where the engineered cells or organisms exhibit increased or decreased RNA and/or polypeptide levels as compared to the host cell or organism.

The promoter used for regulating transcription of a heterologous nucleic acid encoding one or more of the hydratase and dehydrogenase enzymes (for example, of a multifunctional enzyme) can also be modified. For example, the amount of one or more of the hydratase and dehydrogenase enzymes (for example, of a multifunctional enzyme protein) expressed in a particular cellular location may be increased or decreased by including in the heterologous nucleic acid a stronger or weaker heterologous promoter and/or a promoter that provides for a different pattern of expression in the cell or microorganism.

Alternatively, decreasing the activity of one or more of the hydratase and dehydrogenase enzymes (for example, of a multifunctional enzyme) in a cell can be accomplished by modifying the amount of expression of one or more of the hydratase and dehydrogenase enzymes (for example, of a multifunctional enzyme) in the cell, for example, by replacing the wild-type promoter of an endogenous multifunctional enzyme gene (or an enoyl-CoA hydratase or 3-hydroxyacyl-CoA dehydrogenase gene) in a cell or organism with a weaker heterologous promoter, deleting or disrupting an endogenous gene, and/or replacing or modifying a gene encoding a wild-type multifunctional enzyme (or an enoyl-CoA hydratase or 3-hydroxyacyl-CoA dehydrogenase) such that the encoded modified or substituted protein has a reduced enzyme(s) activity.

Modification of 3-Ketoacyl-CoA Thiolase Activity

In a final step of the β-oxidation pathway, 3-ketoacyl-CoA can undergo thiolytic cleavage to yield a fatty acyl-CoA shortened by 2 carbons and acetyl-CoA. The reaction can be catalyzed by 3-ketoacyl-CoA thiolase (e.g., EC 2.3.1.16; also referred to as β-ketothiolase, acetyl-CoA acyltransferase) and involves cleavage of the 3-ketoacyl-CoA by the thiol group of another molecule of CoA. The thiol is inserted between C-2 and C-3, which yields an acetyl CoA molecule and an acyl CoA molecule that is two carbons shorter.

In some embodiments of the cells, organisms, compositions and methods provided herein, the amount and/or activity of a 3-ketoacyl-CoA thiolase in a cell is modified. For example, in some aspects, a cell or microorganism may be modified to increase the amount and/or activity of a 3-ketoacyl-CoA thiolase, may be modified to decrease the amount and/or activity of a 3-ketoacyl-CoA thiolase, or may be modified to alternately increase and decrease the amount and/or activity of a 3-ketoacyl-CoA thiolase depending, for example, on the substrate specificity, cellular location(s) of the enzyme and/or on the conditions in which the modified cell or microorganism is cultured.

In certain aspects, the amount and/or activity of a 3-ketoacyl-CoA thiolase in a cell is increased. Increasing the amount and/or activity of a 3-ketoacyl-CoA thiolase may be particularly beneficial in embodiments in which the flux of carbons from fatty acids is directed toward a particular target product pathway involving oxidative metabolism and away from other cellular metabolic pathways not involved in target molecule production.

In certain embodiments, the 3-ketoacyl-CoA thiolase activity is unchanged in a host or engineered cell or organism. In one embodiment, the amount and/or activity of a host 3-ketoacyl-CoA thiolase can be increased, for example, by increasing the number of copies of a nucleic acid encoding a 3-ketoacyl-CoA thiolase (e.g., 1, 2, 3, 4, 5, 6, 7, 8, 9, 10, 15, 20, 25 or more copies of the nucleic acid), by increasing the activity of a promoter that regulates transcription of a nucleic acid encoding a 3-ketoacyl-CoA thiolase, or by increasing the number of copies of a nucleic acid encoding a 3-ketoacyl-CoA thiolase and increasing the activity of a promoter that regulates transcription of a nucleic acid encoding a 3-ketoacyl-CoA thiolase. In some embodiments, a 3-ketoacyl-CoA thiolase is endogenous to the host cell or microorganism. In one aspect of the cell or microbial systems and methods provided herein, the amount of a 3-ketoacyl-CoA thiolase protein expressed in a cell can be increased by introducing heterologous nucleic acid encoding a 3-ketoacyl-CoA thiolase into a cell or microorganism. For example, introduction of heterologous nucleic acid encoding a 3-ketoacyl-CoA thiolase can result in increased copy number of such nucleic acids and/or provide for modification of the cellular location in which the protein is expressed.

Non-limiting examples of organisms that include, or can be used as donors for, a 3-ketoacyl-CoA thiolase enzyme include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*). In a particular embodiment, a 3-ketoacyl-CoA thiolase enzyme can be a *Candida* yeast protein. Examples of nucleotide sequences encoding polypeptides having 3-ketoacyl-CoA thiolase activity include, but are not limited to: *Saccharomyces cerevisiae* FOX1 (Genbank accession no. NM_001179508), *Candida tenuis* (Genbank accession no. XM_006688917), *Candida tropicalis* CT-T3A (Genbank accession no. AB025647), *Candida tropicalis* CT-T3B (Genbank accession no. AB025648), *Yarrowia lipolytica* POT1 (Genbank accession no. XM_504109, X69988), *Scheffersomyces stipitis* POT11 (Genbank accession no. XM_001386372), *Debaryomyces fabyri* (Genbank accession no. XM_015611011), *Arabidopsis thaliana* KAT2 (Genbank accession no. NM_128874), *Lillium cultivar Belladonna* (Genbank accession no. KR998331) and *Populus davidianna* KAT (Genbank accession no. KU297273).

Presence, absence or amount of 3-ketoacyl-CoA thiolase activity can be detected by any suitable method known in the art and/or described herein. For example, detection can be performed using enzyme activity assays (see, e.g., Staack et al. (1978) *J. Biol. Chem* 253: 1827-1831; Kurihara et al. (1988) *FEBS Lett.* 229(1):215-218). Nucleic acid sequences representing native and/or modified 3-ketoacyl-CoA thiolase-encoding sequences also can be detected using nucleic acid detection methods (e.g., PCR, primer extension, nucleic acid hybridization, the like and combinations thereof), or the amounts of the nucleic acids or encoded proteins can be assessed using quantitative expression based analysis (e.g., RT-PCR, western blot analysis, northern blot analysis, the like and combinations thereof), where the engineered cells or organisms exhibit increased or decreased RNA and/or polypeptide levels as compared to the host cell or organism.

The promoter used for regulating transcription of a heterologous nucleic acid encoding a 3-ketoacyl-CoA thiolase can also be modified. For example, the amount of a 3-ketoacyl-CoA thiolase protein expressed in a particular cellular location may be increased by including in the heterologous nucleic acid a strong heterologous promoter and/or a promoter that provides for a different pattern of expression in the cell or microorganism. An example of one such heterologous promoter is a *Candida* hydratase-dehydrogenase-epimerase (HDE) gene promoter. The nucleotide sequence of a *Candida viswanathii* HDE gene promoter is provided herein as are examples of additional fatty acid-inducible promoters.

Alternatively, decreasing 3-ketoacyl-CoA thiolase activity in a cell can be accomplished by modifying the amount of 3-ketoacyl-CoA thiolase protein expression in the cell, for example, by replacing the wild-type promoter of an endogenous 3-ketoacyl-CoA thiolase gene in an organism with a weaker heterologous promoter, deleting or disrupting an endogenous gene, and/or replacing or modifying a gene encoding a wild-type 3-ketoacyl-CoA thiolase such that the encoded modified or substituted 3-ketoacyl-CoA thiolase protein has a reduced enzyme activity.

Modification of Enoyl-CoA Isomerase Activity

Feedstocks, such as, for example, fatty acid distillates and soapstocks, can comprise unsaturated fatty acids, for example, such as oleic acid (C18:1), linoleic acid (C18:2), and linolenic acid (C18:3). In some embodiments, unsaturated fatty acids are converted to dicarboxylic acids that maintain the position and orientation of the double bonds. Unsaturated fatty acids generally are degraded through the same reactions that degrade saturated fatty acids until a $\Delta3$-cis-acyl-CoA or $\Delta2$-cis-acyl-CoA is formed in the process of $\beta$-oxidation. Cells can employ additional enzymes to allow the oxidation of these types of unsaturated fatty acids or diacids. In some instances, an enzyme enoyl-CoA isomerase (ECI) is required for the beta-oxidation of substrates with double bonds at odd numbered positions. In some instances, the enzyme dienoyl-CoA reductase (DCR) is required for the beta-oxidation of substrates with double bonds at even numbered positions.

Enoyl-CoA isomerase (ECI) can also be known as enoyl-CoA delta isomerase 1, dodecenoyl-CoA isomerase, 3,2 trans-enoyl-CoA isomerase, acetylene-allene isomerase, $\Delta3$ $\Delta2$-enoyl-CoA isomerase, dodecenoyl-CoA delta isomerase, and EC 5.3.3.8 (in human for example). Several alternatively spliced transcript variants are also known. ECI is a member of the hydratase/isomerase superfamily. ECI can be a key mitochondrial enzyme involved in beta-oxidation of unsaturated fatty acids. This enzyme can isomerize both 3-cis and 3-trans double bonds into the 2-trans form in a range of ECI enzymes from different species. ECI can catalyze the transformation of 3-cis and 3-trans-enoyl-CoA esters arising during stepwise degradation of cis-, mono-, and polyunsaturated fatty acids to the 2-trans-enoyl-CoA intermediates. ECI is present in many microorganisms and several species of yeast have at least two ECI enzymes. Nucleotide sequences (and corresponding amino acid sequences) encoding enoyl-CoA isomerase enzymes from *Candida* strain ATCC 20336 are provided herein (nucleotide SEQ ID NOS: 106 and 107 and amino acid SEQ ID NOS: 50 and 51). Examples of nucleotide sequences encoding polypeptides having enoyl-CoA isomerase activity include, but are not limited to: *Saccharomyces cerevisiae* ECI1 (Genbank accession no. AF090442) and *Candida albicans* (Genbank accession no. XM_711189).

In some embodiments, ECI is utilized in generating a target fatty acid product through $\beta$-oxidation of an unsaturated fatty because of its activity and the normal position of double bonds in some feedstocks (e.g., soapstocks and fatty acid distillates). Many unsaturated fatty acids have a cis-$\Delta9$ double bond. During the $\beta$-oxidation of an 18-carbon diacid with a cis-$\Delta9$ double bond, the double bond is encountered when it has been chain shortened to 12 carbons. At this stage the 12-carbon molecule can have a cis-$\phi3$ double bond that is not a substrate for an acyl-CoA oxidase. ECI can convert the cis-$\Delta3$ double bond to a trans-$\Delta2$ double bond. In some instances, the product of the ECI reaction is a substrate for the second step in beta-oxidation (e.g., a substrate for enoyl-CoA hydratase), and ECI can effectively bypass acyl-CoA oxidase in a particular round of beta-oxidation. In some instances, even if a yeast strain lacks any acyl-CoA oxidase that is active on fatty acids of less than or equal to C12 (i.e., 12 carbons), an active ECI can effect the shortening of one more rounds of $\beta$-oxidation, which can produce a 10-carbon product for substrates with a cis-$\Delta9$ double bond. Therefore, in some embodiments, the ECI gene is disrupted (e.g., knocked out or deleted) in a yeast (e.g., in a *Candida* strain) to prevent chain shortening past a desired chain-length (e.g., in this instance, 12 carbons). In some embodiments, disrupting the expression (e.g. knocking out the expression) of an ECI gene can result in an increase in the production of a fatty dicarboxylic acid containing 10 to 18 carbons. In some embodiments, disrupting the expression (e.g. knocking out the expression) of an ECI gene can result in an increase in the production of a fatty dicarboxylic acid containing 10, 12, 14, 16 or 18 carbons. In some embodiments, disrupting the expression of an enoyl-CoA isomerase can increase the production of fatty dicarboxylic acid containing 10, 12, 14, 16 or 18 carbons when using certain feedstocks (e.g., certain soapstocks or fatty acid distillates).

In some embodiments, an ECI knock out (i.e., eciΔ or Eci⁻) strain is able to produce DDDA from from fatty acid feedstocks containing unsaturated fatty acids (e.g., oleic acid, linoleic acid, linolenic acid) even in the presence of acyl-CoA oxidase with activity on substrates of chain-length less than 12 carbons (but with little or nor activity on substrates having 12 carbons in the chain). This can be accomplished, for example, by discontinuation of β-oxidation after obtaining 3-dodecendioic acid (e.g., from oleic acid feedstock), 3,6-dodecenedioc acid (e.g., from linoleic acid feedstock) or 3,6,9-dodecenedioc acid (e.g., from linolenic acid feedstock) through an initial three rounds of β-oxidation (due to the lack of enoyl-CoA isomerase activity), and then hydrogenation of the dodecendioic acids to yield a fully saturated DDDA.

Thus, in some embodiments, a 12-carbon dicarboxylic acid produced from fatty acid feedstocks containing unsaturated fatty acids can be hydrogenated to generate a the fully saturated DDDA product. An unsaturated diacid sometimes is produced from a feedstock containing an unsaturated fatty acid, and production of a fully saturated diacid in such situations can involve hydrogenation of the unsaturated diacid. For example, an unsaturated C6:1 diacid generated from one or more long chain unsaturated fatty acids in an Eci⁻ yeast strain which also lacks acyl-CoA oxidase enzymes having activity on substrates of 6-carbon chain lengths (e.g., a pox4Δ yeast strain) can be converted to a fully saturated C6:0 diacid by reducing the double bond by a suitable method. Non-limiting examples of hydrogenation methods include the use of a metallic chemical catalyst, non-metallic chemical catalyst, enzymatic catalyst, the like or combination thereof.

A non-limiting example of a hydrogenation reaction is shown below. Sometimes source hydrogen is provided from molecular hydrogen (e.g., in the case of chemical catalysis) and sometimes source hydrogen is provided from enzymatic cofactors, non-limiting examples of which include NADH, NADPH, FADH2, the like or combination thereof (e.g., in the case of enzymatic catalysis).

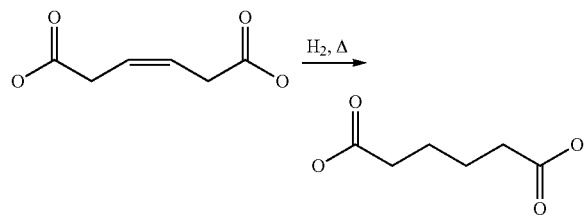

In some embodiments, catalytic hydrogenation is carried out with a suitable metallic catalyst, non-limiting examples of which include platinum, palladium, rhodium, ruthenium, nickel, the like or combination thereof. Sometimes a catalyst is a homogenous catalyst and sometimes a catalyst is a heterogeneous catalyst. An elevated temperature and/or pressure can be employed to increase reaction rate. For example, an unsaturated diacid (e.g., cis, cis-muconic acid) can be hydrogenated and converted to adipic acid using a 10% Pt on carbon catalyst at 3400 kPa for 2.5 hours at ambient temperature (Niu et al., (2002) Biotechnol. Prog. 18:201-211). In some embodiments, catalytic hydrogenation can occur with nonmetallic catalysts such as frustrated Lewis pair compounds (Welch et al., (2006) Science 314: 1124-1126).

In certain embodiments, enzymatic hydrogenation is conducted in vivo or in vitro with a suitable native or engineered enzyme that can catalyze a redox reaction with an unsaturated diacid or fatty acid as a substrate or a product. An enzyme can be utilized in vivo in some embodiments by increasing expression of a native enzyme or expressing a non-native enzyme capable of catalyzing a desired hydrogenation reaction in an organism that produces an unsaturated diacid precursor of a saturated diacid product. A lysate of an organism containing an enzyme capable of catalyzing a desired hydrogenation reaction, or a purified or isolated enzyme preparation, sometimes is utilized in an in vitro reaction. Non-limiting examples of a suitable native or engineered enzyme include acyl-CoA dehydrogenase (EC 1.3.1.8), trans-2-enoyl-CoA reductase (EC 1.3.1.44), stearoyl-CoA 9-desaturase (EC 1.14.19.1), the like or combination thereof. In some embodiments, a desired reaction product (e.g., a saturated diacid) is produced by an enzyme operating in a forward or a reverse direction (e.g., a forward or reverse reaction).

Modification of Dienoyl-CoA Reductase Activity

Dienoyl CoA reductase (DCR, e.g., EC 1.3.1.34) is a peripheral enzyme that can convert trans-2, cis-4 dienoyl-CoA substrates to trans-3-enoyl-CoA products (Gurvitz A, et al., (1997) J. Biol. Chem. 272:22140-22147).

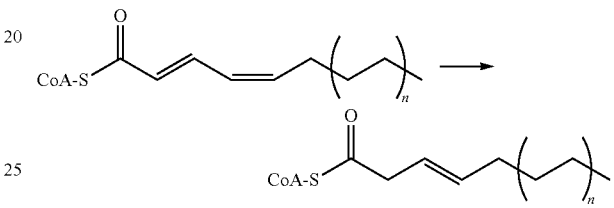

The trans-3-enoyl-CoA is then converted by the enzyme enoyl-CoA isomerase (ECI) to trans-2-enoyl-CoA which is then the substrate for the second enzyme (enoyl-CoA hydratase) in β-oxidation. Complete β-oxidation of fatty acids, including diacids, with double bonds at even numbered positions (e.g., linoleic acid (C18:2) and linolenic acid (C18:3)) can be achieved by including the DCR reaction in the β-oxidation pathway. Diacids are capable of being oxidized starting from either end (diterminal β-oxidation), and sometimes the enzymes used to rearrange and degrade the double bonds are the same from either direction. This is because even-numbered diacids with double bonds at even-numbered positions maintain the even-numbered position from either end (similarly with double bonds at odd-numbered positions).

The DCR reaction can be used for complete β-oxidation of fatty acids with double bonds at even numbered positions, such as linoleic acid and linolenic acid. Depending on the carbon chain length of a desired final diacid product, it may be useful to either amplify or reduce the activity of one or more DCR enzymes in the host cell or engineered organism. For diacid products that have a carbon chain length of eight or greater, it may be useful or desirable to reduce or eliminate one or all DCR enzymes in the host cell. For diacid products that have a carbon chain length of less than eight carbons, it may be useful or desirable to amplify the activity of one or more DCR enzymes in the host cell or engineered organism.

Table 1 is a table of diacid products that may be produced from unsaturated fatty acids using a yeast strain in which the ECI and/or DCR genes have been disrupted or deleted. A Dcr strain that does not include mutations of other genes encoding enzyme activities of the β-oxidation pathway typically can produce exclusively a C8:3 diacid. In some embodiments, a DCR polypeptide is not decreased, such as by disrupting a Dcr-encoding polynucleotide, in a strain utilized to produce a diacid product (e.g., adipic acid sebacic acid, DDDA). In certain embodiments, Dcr polypeptide production is increased (e.g., introducing additional copy numbers of an endogenous Dcr-encoding polynucleotide; introducing one or more copies of a heterologous Dcr-encoding polynucleotide) to produce adipic acid from polyunsaturated fatty acids, such as those prevalent in soybean or corn oil.

TABLE 1

| Fatty Acid Carbon Source | Diacids Produced in a Pox4+, Pox5+ Background | | |
|---|---|---|---|
| | Eci− Product | Dcr− Product | Eci−, Dcr− Product |
| Oleic acid (C18:1) | C6:1 (3-hexenedioic acid) | None | C6:1 (3-hexenedioic acid) |
| Linoleic acid (C18:2) | C10:2 (3,7-decenedioc acid) | C8:3 (2,4,6-octenedioic acid) | C10:3 (2,4,7-decenedioic acid) |
| Linolenic acid (C18:3) | C12:3 (3,6,9-dodecenedioc acid) | C8:3 (2,4,6-octenedioic acid) | C12:3 (3,6,9-dodecenedioic acid) |
| Eicosenoic acid (C20:1) | C6:1 (3-hexenedioic acid) | None | C6:1 (3-hexenedioic acid) |
| Erucic acid (C22:1) | C6:1 (3-hexenedioic acid) | None | C6:1 (3-hexenedioic acid) |

In yeast such as *Candida tropicalis* and *Candida viswanathii*, there are two DCR homologs, often referred to as DCR1 and DCR2. The yeast *Saccharomyces cerevisiae* includes one Dcr enzyme, while the yeast *Yarrowia lipolytica* includes at least three DCR homologs, referred to herein as "DCR1", "DCR2", and "DCR3". Nucleotide sequences (and corresponding amino acid sequences) encoding dienoyl-CoA reductase enzymes from *Candida* strain ATCC 20336 are provided herein (nucleotide SEQ ID NOS: 108 and 109 and amino acid SEQ ID NOS: 52 and 53). Examples of nucleotide sequences encoding polypeptides having dienoyl-CoA reductase activity include, but are not limited to: *Saccharomyces cerevisiae* SPS19 (Genbank accession no. NM_001183040), *Candida tropicalis* SPS19 (Genbank accession no. XM_002545237) and *Yarrowia lipolytica* (Genbank accession nos. XM_501382, XM_503937, XM_502296).

Accordingly, there are multiple possible genotypes of yeast strains (having varying combinations of wild-type and mutant acyl-CoA oxidase activity specificities and functional or non-functional ECI and/or DCR genes) for the production of fatty acids and diacids of differing carbon chain lengths and degrees of saturation/unsaturation. The fatty acid or diacid produced can depend on the carbon source in the feedstock. Table 2 provides non-limiting examples of some of the yeast strain (e.g., *Candida* spp.) genotype combinations and carbon sources for the production of adipic acid, suberic acid, sebacic acid and DDDA.

TABLE 2

| DIACID PRODUCT | STRAIN GENOTYPE (with respect to POX4/ECI/DCR) AND CARBON SOURCE COMBINATIONS | | |
|---|---|---|---|
| | OLEIC ACID | LINOLEIC ACID | LINOLENIC ACID |
| Adipic acid (C6) | pox4Δ/ECI/DCR (yields saturated diacid) POX4/Eci−/DCR (yields 3-hexenedioic acid*) | pox4Δ/ECI/DCR (yields saturated diacid) | pox4Δ/ECI/DCR (yields saturated diacid*) |
| Suberic acid (C8) | pox4Δ/ECI/DCR (yields saturated diacid) pox4Δ/Eci−/DCR (yields 3-octenedioic acid*) | pox4Δ/ECI/DCR (yields saturated diacid) POX4/ECI/Dcr− (yields 2,4,6-octenedioic acid*) POX4/Eci−/DCR (yields 3,6-octenedioic acid*) | POX4/ECI/Dcr− (yields 2,4,6-octenedioic acid*) |
| Sebacic acid (C10) | | POX4/Eci−/DCR or pox4Δ/Eci−/DCR (yields 3,7-decenedioic acid*) POX4/Eci−/Dcr− (yields 2,4,7-decenedioic acid*) | |
| Dodecanedioic acid (C12) | | | POX4/Eci−/DCR or pox4Δ/Eci−/DCR (yields 3,6,9-dodecenedioic acid*) |

*can be hydrogenated to saturate

Modification of Dienoyl-CoA Isomerase Activity

Dienoyl-CoA isomerase (DCI, e.g., EC 5.3.3, Δ3,5,Δ2,4-dienoyl-CoA isomerase, Δ3,5,Δ2,4-dienoyl-coenzyme A isomerase) is a peripheral β-oxidation enzyme that catalyzes the isomerization of a Δ3,5-dienoyl-CoA to a Δ2,4-dienoyl-CoA. This reaction is part of a minor β-oxidation pathway that occurs when the 3,2-enoyl-CoA isomerase (ECI) converts a Δ2,5-dienoyl-CoA to a Δ3,5-dienoyl-CoA. In order to fully oxidize this product DCI converts the Δ3,5-dienoyl-CoA to a Δ2,4-dienoyl-CoA, the latter of which is a substrate for the 2,4-dienoyl-CoA reductase (DCR). The product of the DCR reaction is a 3-enoyl-CoA, which is a substrate for ECI that converts it to a 2-enoyl-CoA that can be fully oxidized through β-oxidation.

In some embodiments, the amount and/or activity of a Dci enzyme in a cell or organism is decreased or increased, depending upon the chain-length of a desired target diacid product to be generated through β-oxidation of a fatty acid. For example, for adipic acid production, a DCI activity can be increased to improve productivity of unsaturated fatty acids in a host cell or organism (e.g., DCI activity can be increased by introducing one or more copies of a polynucleotide encoding a polypeptide having DCI activity into the cell or organism (e.g., introducing one or more copies of an endogenous or exogenous polynucleotide)). In some embodiments, for production of C8 and longer diacids, the amount and/or activity of a DCI enzyme in a cell or organism can be decreased (e.g., by introducing a disruption, deletion or knockout of a polynucleotide that encodes a polypeptide having DCI activity, or replacing a promoter of a DCI gene with a weaker promoter (for example, introducing a nucleic acid containing a weak promoter operably linked to a polynucleotide that encodes a polypeptide having DCI activity into a cell in which an endogenous DCI gene has been disrupted or deleted). An example of a nucleotide sequence encoding a *Saccharomyces cerevisiae* DCI enzyme is Genbank accession no. NM_001183599.

Modification of β-Oxidation-Associated Activities

There are also cellular compositions and activities that are closely associated with β-oxidation and support the core degradative functioning of the pathway. These include peroxisomal- and mitochondrial-related compositions and activities. For example, as described herein, such compositions and activities include, but are not limited to, compositions and activities involved in: generating acyl-CoA through thioesterification of fatty acids, movement of fatty acids and/or acyl-CoA into cellular sites of β-oxidation (e.g., peroxisomes), regulation of β-oxidation activities, synthesis of compositions involved in β-oxidation, and maintenance/amount of sites of β-oxidation (e.g., peroxisomes). Included in the cells, organisms, systems and methods provided herein are embodiments in which one or more of these β-oxidation-associated compositions and/or activities are modified. In some embodiments, a β-oxidation-associated composition or activity is modified to enhance β-oxidation activity.

Modification of Peroxisomal Transport Activity

In order for fatty acids to undergo peroxisomal β-oxidation, they must first move into the peroxisomes. Generally, medium-chain free fatty acids present in the cytosol can traverse the peroxisomal membrane and become activated once in the peroxisome by a persoxisomal acyl-CoA synthetase to then be processed as an acyl-CoA in β-oxidation. Long-chain fatty acids that have entered a cell from the extracellular medium tend to quickly be activated by acyl-CoA synthetases located at or near the cell membrane or in the cytosol. These acyl-CoA esters typically are not able to traverse the peroxisomal membrane and thus require a peroxisomal transporter in order to move into peroxisomes. Peroxisomal transporter proteins can be a target for modifying entry of fatty acids into peroxisomes. Free fatty acids internalized into cells, or generated within cells (e.g., by oxidation of internalized alkanes), can directly enter into and be processed in the ω-oxidation pathway without prior activation to acyl-CoA.

In some embodiments of the microorganisms, compositions and methods provided herein, the amount and/or activity of a peroxisomal transporter protein in a cell is modified. For example, in some aspects, a cell or microorganism may be modified to increase the amount of a peroxisomal transporter protein and/or a peroxisomal transporter protein activity, may be modified to decrease the amount of a peroxisomal transporter protein and/or a peroxisomal transporter protein activity, or may be modified to alternately increase and decrease the amount of a peroxisomal transporter protein and/or a peroxisomal transporter protein activity depending, for example, on the cellular location(s) of the enzyme and/or on the conditions in which the modified cell or microorganism is cultured.

In certain aspects, the amount and/or activity of a peroxisomal transporter protein in a cell is decreased. Reducing or eliminating the amount and/or activity of a peroxisomal transporter protein may be particularly beneficial in embodiments in which the flux of carbons from fatty acids is directed toward a particular target product pathway (e.g., in peroxisomes) and away from other cellular metabolic pathways involving activated fatty acids (acyl-CoA). For example, in embodiments of the production systems in which a target molecule, or intermediate/precursor of a target molecule, is a dicarboxylic acid, it may be optimal to decrease or eliminate fatty acid entry into peroxisomes through modes other than as a dicarboxylic acid which moves freely into peroxisomes after formation though an initial ω-oxidation of a free fatty acid. Certain aspects of the cells, microorganisms, compositions and methods provided herein include one or more modifications to reduce or eliminate transport of acyl-CoA into peroxisomes. One approach to reducing or eliminating such transport is to decrease the amount and/or activity of a peroxisomal transporter protein. For example, one or more endogenous genes encoding a peroxisomal transporter protein (e.g., yeast PXA1 and/or PXA2) can be disrupted or deleted in a host cell or microorganism to reduce or eliminate the amount of and/or activity of a peroxisomal transporter protein in the host relative to a cell or microorganism in which the gene(s) have not been modified.

Methods for decreasing the amount and/or activity of a peroxisomal transporter protein in a cell include, but are not limited to, modifying the amount of peroxisomal transporter protein expression in the cell, for example, by replacing the wild-type promoter of an endogenous a peroxisomal transporter protein gene in an organism with a weaker heterologous promoter, deleting or disrupting an endogenous gene, and/or replacing or modifying a gene encoding a wild-type peroxisomal transporter protein such that the encoded modified or substituted peroxisomal transporter protein has a reduced activity. For example, expression of a host peroxisomal transporter protein activity can be decreased or eliminated by disruption (e.g., knockout, insertion mutagenesis, the like and combinations thereof) of a host gene encoding the protein, or by decreasing the activity of the promoter (e.g., through addition of repressor sequences to the promoter or 5'UTR or replacing the promoter) that controls transcription of a peroxisomal transporter protein gene using recombinant molecular biology techniques known in the art and/or described herein. In one embodiment, a diploid yeast, such as, for example, a *Candida* yeast, when used as a host microorganism can be subjected to genetic modification in which one of the two alleles of a peroxisomal transporter protein gene is disrupted or deleted. In so doing, a single allele of the gene remains for a reduced amount of peroxisomal transporter protein expression in the microorganism and a reduced amount of the protein in the cell.

One method for disrupting an endogenous peroxisomal transporter protein gene is by recombinantly inserting a heterologous nucleic acid (e.g., a nucleotide sequence encoding a selectable marker such as an enzyme that restores an auxotrophic host organism to prototrophy) into the endogenous gene, thereby generating an engineered organism deficient in a peroxisomal transporter protein activity. This can be done, for example, through homologous recombination in which a heterologous nucleic acid containing sequences of an endogenous peroxisomal transporter protein gene and a disrupting sequence (e.g., a knock-out gene cassette such as described herein) is introduced into a host cell or microorganism. Nucleic acids encoding a peroxisomal transporter protein can be obtained from a number of sources, including, for example, yeast cells. Genomic DNA from cell sources can be amplified using oligonucleotide primers based on the nucleotide sequence of a peroxisomal transporter protein encoding gene, including examples provided herein. Nucleotide sequences encoding the subunits of (and the amino acid sequences of) a *Candida viswanathii* peroxisomal transporter protein, Pxa1 and Pxa2, are provided herein (nucleotide SEQ ID NOS: 94 and 95 and amino acid SEQ ID NOS: 40 and 41). Additional non-limiting examples of nucleic acids encoding a peroxisomal transporter protein include *Saccharomyces cerevisiae* PXA1 (Genbank accession numbers NM_001183961 and U17065), *Saccharomyces cerevisiae* PXA2 (Genbank accession numbers NM_001179754 and U93584), *Schizosaccharomyces pombe* PXA1 (Genbank accession number NM_001018794), *Candida albicans* PXA1 (Genbank accession number XM_713564), *Yarrowia lypolytica* PXA1 (Genbank accession number XM_499814), *Yarrowia lypolytica* PXA2 (Genbank accession number XM_502396), *Candida orthopsilosis* PXA1 (Genbank accession number XM_003865834), *Aspergillus nomius* PXA1 (Genbank accession number XM_015554863), *Clavispora lusitaniae* PXA1 (Genbank accession number JQ710938), *Aspergillus niger* PXA1 (Genbank accession number XM_001388761) and *Arabidopsis thalina* ABCD1 (Genbank accession number NM_001204043).

In other embodiments, the amount and/or activity of a host peroxisomal transporter protein can be increased, for example, by increasing the number of copies of a gene encoding a peroxisomal transporter protein (e.g., 1, 2, 3, 4, 5, 6, 7, 8, 9, 10, 15, 20, 25 or more copies of the gene), by increasing the activity of a promoter that regulates transcription of a gene encoding a peroxisomal transporter protein, or by increasing the number of copies of a gene encoding a peroxisomal transporter protein and increasing the activity of a promoter that regulates transcription of a gene encoding a peroxisomal transporter protein. In some embodiments, a peroxisomal transporter protein is endogenous to the host cell or microorganism. In particular embodiments, the amount and/or activity of a host peroxisomal transporter protein is increased.

The presence, absence or amount of peroxisomal transporter protein can be detected by any suitable method known in the art. Non-limiting examples of suitable detection methods include nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cells or organisms exhibit increased or decreased RNA and/or polypeptide levels as compared to the host cell or organism.

Modification of Peroxisome Biogenesis Activity

Peroxisomes can be found in eukaryotic cells and are a cellular location for β-oxidation (i.e., the site for β-oxidation in fungi and plant cells and one of two sites (the other being mitochondria) for β-oxidation of fatty acids in animal cells). Consistent with this function, peroxisome proliferation may occur in cells exposed to fatty acids as a sole source of carbon, and peroxisome degradation may occur in cells in the presence of glucose. Thus, the number of and volume of peroxisomes in cells can be regulated. Although most of the more than 30 peroxisomal membrane proteins, referred to as peroxins or Pex proteins, play a role in importing proteins into the peroxisomal matrix from the cytosol (e.g., Pex5, Pex7, Pex13, Pex14 Pex16, Pex17), some (e.g. Pex 11, Pex 25, Pex 27, Pex 34) are involved in peroxisome proliferation.

In some embodiments of the cells, organisms, compositions and methods provided herein, the amount and/or activity of a Pex protein in a cell is modified. For example, in some aspects, a cell or microorganism may be modified to increase the amount and/or activity of a Pex protein, to decrease the amount and/or activity of a Pex protein, or to alter the pattern of expression of a Pex protein. In particular embodiments, the Pex protein is one that is involved in peroxisome proliferation, e.g., Pex11.

In certain aspects, the amount and/or activity of a Pex protein in a cell or organism is increased. Increasing the amount and/or activity of a Pex protein may be particularly beneficial in embodiments in which the flux of carbons from fatty acids is directed toward a particular target product pathway involving oxidative metabolism and away from other cellular metabolic pathways not involved in target molecule production. In some embodiments, the amount and/or activity of a Pex protein involved in peroxisome proliferation is increased in a cell or organism to provide for increased numbers of peroxisomes as sites for β-oxidation. In particular embodiments, the Pex protein is Pex11.

In certain embodiments, the Pex protein activity is unchanged in a host or engineered cell or organism. In one embodiment, the amount and/or activity of a host Pex protein can be increased, for example, by increasing the number of copies of a nucleic acid encoding a Pex protein (e.g., 1, 2, 3, 4, 5, 6, 7, 8, 9, 10, 15, 20, 25 or more copies of the nucleic acid), by increasing the activity of a promoter that regulates transcription of a nucleic acid encoding a Pex protein, or by increasing the number of copies of a nucleic acid encoding a Pex protein and increasing the activity of a promoter that regulates transcription of a nucleic acid encoding a Pex protein. In some embodiments, a Pex protein is endogenous to the host cell or microorganism. In one aspect of the cell or microbial systems and methods provided herein, the amount of a Pex protein expressed in a cell can be increased by introducing heterologous nucleic acid encoding a Pex protein into a cell or microorganism. For example, introduction of heterologous nucleic acid encoding a Pex protein can result in increased copy number of such nucleic acids and/or provide for modification of the cellular location in which the protein is expressed.

Non-limiting examples of organisms that include, or can be used as donors for, a Pex protein include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), or plants (e.g., *Arabidopsis, Nictotania, Cuphea*). In a particular embodiment, a Pex protein can be a *Candida* yeast protein. An example of a *Candida viswanathii* nucleotide sequence (and corresponding amino acid sequence) encoding a Pex11 protein is provided herein (nucleotide SEQ ID NO: 89 and amino acid SEQ ID NO: 33). Additional examples of nucleotide sequences encoding polypeptides having Pex protein activity include, but are not limited to: *Saccharomyces cerevisiae* PEX11 (Genbank accession no. NM_001183401), *Candida albicans* (Genbank accession no. XM_707009), *Candida orthopsilosiis* PEX11 (Genbank accession no. XM_003870517), *Yarrowia lipolytica* PEX11 (Genbank accession nos. XM_503276, XM_501447, XM_501425), *Arabidopsis thaliana* PEX11A (Genbank accession no. NM_103668), *Neurospora crassa* PEX11 (Genbank accession no. XM_011396615), *Pichia angusta* PEX11 (Genbank accession no. DQ645582).

Presence, absence or amount of Pex protein or nucleic acids encoding the protein can be detected by any suitable method known in the art and/or described herein. For example, detection can be performed using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered cells or organisms exhibit increased or decreased RNA and/or polypeptide levels as compared to the host cell or organism.

The promoter used for regulating transcription of a heterologous nucleic acid encoding a Pex protein can also be modified. For example, the amount of a Pex protein expressed in a particular cellular location may be increased by including in the heterologous nucleic acid a strong heterologous promoter and/or a promoter that provides for a different pattern of expression in the cell or microorganism. An example of one such heterologous promoter is a *Candida* hydratase-dehydrogenase-epimerase (HDE) gene promoter. The nucleotide sequence of a *Candida viswanathii* HDE gene promoter is provided herein as are examples of additional fatty acid-inducible promoters.

Modification of Acetyl-CoA Processing in Peroxisomes

Included in the cell-based and microbial production platform systems and components thereof provided herein are embodiments in which the processing of acetyl-CoA in organelles of a cell or microorganism is modified. In some embodiments, acetyl group carbons of organelle-generated acetyl-CoA are directed toward conversion to acetate. In particular embodiments, acetyl group carbons are directed toward conversion to acetate and away from the carnitine-carrier transport system. Accordingly, provided herein are cells, microorganisms, compositions and methods in which cellular carbon flux has been modified through the altered (e.g., increased or decreased) de novo generation of cellular acetate. In particular embodiments, cellular carbon flux has been modified to increase the production of acetate in a cell and/or a particular cellular location. In certain aspects, cells or microorganisms are modified to increase the production of acetate in peroxisomes.

Modification of Acetyl-CoA Hydrolase Activity

In some embodiments of the cells, microorganisms, compositions and methods provided herein, the amount and/or activity of acetyl-CoA hydrolase in a cell is modified. Acetyl-CoA hydrolase (e.g. EC 3.1.2.1) is an enzyme that catalyzes the hydrolysis of acetyl-CoA to form acetate and CoA. For example, in some aspects, a cell or microorganism may be modified to increase acetyl-CoA hydrolase and/or acetyl-CoA hydrolase activity, may be modified to decrease acetyl-CoA hydrolase and/or acetyl-CoA hydrolase activity, or may be modified to alternately increase and decrease acetyl-CoA hydrolase and/or acetyl-CoA hydrolase activity depending, for example, on the cellular location(s) of the enzyme and/or on the conditions in which the modified cell or microorganism is cultured.

In some aspects, the amount and/or activity of acetyl-CoA hydrolase in a cell and/or a particular cellular location is increased. For example, the amount and/or activity of acetyl-CoA hydrolase in peroxisomes of a cell can be increased. In some embodiments, the pattern of expression of acetyl-CoA hydrolase can be modified such that the enzyme is produced in a cellular location where it is not produced in an unmodified cell and/or is no longer produced in a cellular location where it is produced in an unmodified cell.

In one aspect, the amount and/or activity of a host acetyl-CoA hydrolase can be increased, for example, by increasing the number of copies of a nucleic acid encoding an acetyl-CoA hydrolase (e.g., 1, 2, 3, 4, 5, 6, 7, 8, 9, 10, 15, 20, 25 or more copies of the nucleic acid), by increasing the activity of a promoter that regulates transcription of a nucleic acid encoding an acetyl-CoA hydrolase, or by increasing the number of copies of a nucleic acid encoding an acetyl-CoA hydrolase and increasing the activity of a promoter that regulates transcription of a nucleic acid encoding an acetyl-CoA hydrolase. In some embodiments, an acetyl-CoA hydrolase is endogenous to the host cell or microorganism. In one aspect of the cell-based and microbial systems and methods provided herein, the amount of acetyl-CoA hydrolase protein expressed in a cell can be increased by introducing heterologous nucleic acid encoding acetyl-CoA hydrolase into a cell or microorganism. For example, introduction of heterologous nucleic acid encoding acetyl-CoA hydrolase can result in increased copy number of such nucleic acids and/or provide for modification of the cellular location in which the protein is expressed.

Acetyl-CoA hydrolase is typically localized to the mitochondrial compartment in eukaryotes. In one embodiment of the cells, microorganisms and methods provided herein, host cells are modified to express engineered acetyl-CoA hydrolase proteins that include targeting signals that direct the enzyme to peroxisomes, thereby introducing, or increasing the amount of, peroxisomal acetyl-CoA hydrolase in the cells. In particular embodiments, the engineered acetyl-CoA hydrolase protein has also been modified to exclude amino acids of a mitochondrial targeting sequence. One such modified acetyl-CoA hydrolase protein is a yeast Ach1p$^{\Delta mts+pts}$ which includes a heterologous peroxisomal targeting signal (pts) and excludes a mitochondrial targeting sequence (mts). In order to express engineered acetyl-CoA hydrolase in a targeted location, such as the peroxisomes, heterologous nucleic acid encoding the modified enzyme can be introduced into host cells. Acetate generated through the action of peroxisomal acetyl-CoA hydrolase can freely diffuse out of the peroxisome into the cytosol where it can be converted back to acetyl-CoA by the enzyme acetyl-CoA synthetase (e.g., EC 6.2.1.1), thereby increasing the generation and amount of cytosolic acetyl-CoA. In a particular embodiment, the acetyl-CoA hydrolase enzyme can be a *Candida* yeast protein. An example of a *Candida viswanathii* nucleotide sequence (ACH1$^{\Delta mts+pts}$ SEQ ID NO: 73)

encoding a modified acetyl-CoA hydrolase lacking a mitochondrial-targeting sequence and including a peroxisomal-targeting sequence (Ach1p$^{\Delta mts+pts}$; SEQ ID NO: 16) is provided herein. Additional examples of nucleotide sequences encoding acetyl-CoA hydrolase proteins include but are not limited to: *Saccharomyces cerevisiae* ACH1 (Genbank accession numbers M31036, NM_001178255), *Candida tropicalis* ACH1 (Genbank accession number XM_002550976), *Candida orthopsilosis* ACH1 (Genbank accession number XM_003870486), *Candida albicans* ACH1 (Genbank accession number XM_709496), *Aspergillus flavus* ACH1 (Genbank accession number XM_002372714), *Neurospora crassa* ACU8 (Genbank accession number XM_953261), *Cyberlindnera jadinii* ACH1 (Genbank accession number AB641818), *Debaryomyces fabryi* ACH1 (Genbank accession number XM_015614474), *Schizosaccharomyces octosporus* ACH1 (Genbank accession number XM_013163018), *Schizosaccharomyces japonicus* ACH1 (Genbank accession number XM_002173925), *Penicillium digitatum* ACH1 (Genbank accession number XM_014683672), *Penicillium marneffei* ACH1 (Genbank accession number XM_002152968) and *Talaromyces stipitatis* ACH1 (Genbank accession number XM_002487448). Any of these, and other such acetyl-CoA hydrolase-encoding nucleic acids, can be analyzed for the presence of 5' ORF nucleotides encoding possible mitochondrial-targeting sequences of amino acids and modified to eliminate such sequences. Nucleotides encoding a peroxisomal-targeting sequence (e.g, a PTS1 sequence such as AKL or SKL) can also be added to the 3' terminus of the coding sequences of the nucleic acids.

The promoter used for regulating transcription of a heterologous nucleic acid encoding an acetyl-CoA hydrolase can also be modified. For example, the amount of an acetyl-CoA hydrolase protein expressed in a particular cellular location may be increased by including in the heterologous nucleic acid a strong heterologous promoter and/or a promoter that provides for a different pattern of expression in the cell or microorganism. An example of one such heterologous promoter is a fatty acid-inducible promoter that can provide for increased acetyl-CoA hydrolase expression, particularly when exposed to fatty acids as a carbon source. Such promoter elements include those that regulate expression of peroxisomal proteins and/or β-oxidation enzymes in microbes, e.g., a *Candida* hydratase-dehydrogenase-epimerase (HDE) gene promoter. The nucleotide sequence of a *Candida viswanathii* HDE gene promoter is provided herein as are examples of additional fatty acid-inducible promoters.

The acetyl-CoA hydrolase activities of host and modified cells and microorganisms can be evaluated and monitored using methods known in the art. Examples of acetyl-CoA hydrolase activity assays include colorimetric assays (see, e.g., Connerton et al. (1992) *J. Gen. Microbiol.* 138:1797-1800; Robinson et al (1976) *Biochem. Biophys. Res. Commun.* 21:959-965) and radioactivity-based and acetylation inhibition assays (see, e.g., U.S. Pat. No. 5,487,990 to Smith et al.). Nucleic acid sequences representing native and/or modified acetyl-CoA hydrolase-encoding sequences also can be detected using nucleic acid detection methods (e.g., PCR, primer extension, nucleic acid hybridization, the like and combinations thereof), or the amounts of the nucleic acids or encoded proteins can be assessed using quantitative expression based analysis (e.g., RT-PCR, western blot analysis, northern blot analysis, the like and combinations thereof), where the engineered cells or organisms exhibit increased or decreased RNA and/or polypeptide levels as compared to the host cell or organism.

Modification of Peroxisomal Carnitine Acetyltransferase Activity

Also provided herein are cells, microorganisms, compositions and methods in which the amount and/or activity of peroxisomal carnitine acetyltransferase in a cell is modified. For example, in some aspects, a cell or microorganism may be modified to increase the amount of peroxisomal carnitine acetyltransferase and/or peroxisomal carnitine acetyltransferase activity, may be modified to decrease the amount of peroxisomal carnitine acetyltransferase and/or peroxisomal carnitine acetyltransferase activity, or may be modified to alternately increase and decrease the amount of peroxisomal carnitine acetyltransferase and/or peroxisomal carnitine acetyltransferase activity depending, for example, on the conditions in which the modified cell or microorganism is cultured.

In some aspects, the amount and/or activity of peroxisomal carnitine acetyltransferase in a cell is decreased. Reducing or eliminating the amount and/or activity of peroxisomal carnitine acetyltransferase may be particularly beneficial in embodiments in which the flux of peroxisomal acetyl moiety carbons is directed toward generation of acetate within peroxisomes. In these embodiments, reducing or eliminating the amount and/or activity of peroxisomal carnitine acetyltransferase decreases the amount of peroxisomal acetyl group carbon atoms that are converted to acetyl-carnitine and provides increased peroxisomal acetyl-CoA availability for generation of peroxisomal acetate. Methods for decreasing peroxisomal carnitine acetyltransferase activity in a cell include, but are not limited to, modifying the amount of peroxisomal carnitine acetyltransferase protein expression in the cell, for example, by replacing the wild-type promoter of an endogenous peroxisomal carnitine acetyltransferase gene in an organism with a weaker heterologous promoter, deleting or disrupting an endogenous gene, and/or replacing or modifying a gene encoding a wild-type peroxisomal carnitine acetyltransferase such that the encoded modified or substituted peroxisomal carnitine acetyltransferase protein has a reduced enzyme activity. For example, expression of a host peroxisomal carnitine acetyltransferase activity can be decreased by disruption (e.g., knockout, insertion mutagenesis, the like and combinations thereof) of a host gene encoding the protein, or by decreasing the activity of the promoter (e.g., through addition of repressor sequences to the promoter or 5'UTR or replacing the promoter) that controls transcription of a peroxisomal carnitine acetyltransferase gene using recombinant molecular biology techniques known in the art and described herein. In one embodiment, a diploid yeast, such as, for example, a *Candida* yeast, when used as a host microorganism can be subjected to genetic modification in which one of the two alleles of a peroxisomal carnitine acetyltransferase gene is disrupted or deleted. In so doing, a single allele of the gene remains for a reduced amount of peroxisomal carnitine acetyltransferase expression in the microorganism and a reduced amount of the protein in the cell.

One method for disrupting an endogenous peroxisomal carnitine acetyltransferase gene is by recombinantly inserting a heterologous nucleic acid (e.g., a nucleotide sequence encoding a selectable marker such as an enzyme that restores an auxotrophic host organism to prototrophy) into the endogenous gene, thereby generating an engineered organism deficient in peroxisomal carnitine acetyltransferase activity. This can be done, for example, through homologous recombination in which a heterologous nucleic acid containing sequences of the endogenous peroxisomal carnitine acetyltransferase gene and a disrupting sequence (e.g., a knock-out gene cassette such as described herein) is introduced into a host cell or microorganism. Nucleic acids encoding a peroxisomal carnitine acetyltransferase can be obtained from a number of sources, including, for example, yeast cells. Genomic DNA from cell sources can be amplified using oligonucleotide primers based on the nucleotide sequence of a peroxisomal carnitine acetyltransferase encoding gene, including examples provided herein.

In some instances, a host gene, e.g., certain yeast genes, encoding a peroxisomal carnitine acetyltransferase also encodes a mitochondrial carnitine acetyltransferase. In these organisms, a peroxisomal carnitine acetyltransferase is encoded by a gene that generates a protein containing mitochondrial and peroxisomal targeting sequences. Therefore, in such an instance, disruption or deletion of a gene encoding a carnitine acetyltransferase that is localized to peroxisomes will result in reducing or eliminating mitochondrial, as well as peroxisomal, carnitine acetyltransferase protein expression. In order to reduce or eliminate peroxisomal carnitine acetyltransferase expression in such cells without eliminating mitochondrial carnitine acetyltransferase expression, a heterologous nucleic acid encoding a mitochondria-targeted carnitine acetyltransferase can be introduced into the cell after disruption of the endogenous gene. For example, a mitochondrial-targeted enzyme that would not be expressed in peroxisomes can be produced in a cell or microorganism by introducing a heterologous nucleic acid that encodes a carnitine acetyltransferase that includes a mitochondrial targeting sequence of amino acids but lacks a peroxisomal targeting sequence of amino acids. An example of such a modified *Candida viswanathii* nucleic acid sequence (CAT2$^{\Delta pts}$; SEQ ID NO: 62), and the amino acid sequence encoded thereby (Cat2p$^{\Delta pts}$; SEQ ID NO: 5), are provided herein.

In another embodiment provided herein, a heterologous nucleic acid encoding a peroxisomal carnitine acetyltransferase that has a reduced carnitine acetyltransferase activity relative to the activity of the enzyme encoded by a host cell's or microorganism's endogenous peroxisomal carnitine acetyltransferase gene can be introduced into a host cell in which the endogenous peroxisomal carnitine acetyltransferase gene(s) has been disrupted or deleted. The heterologous nucleic acid encoding the less active carnitine acetyltransferase can be modified to include nucleotides encoding a peroxisomal targeting sequence for expression of the enzyme specifically in peroxisomes and not in other areas, such as mitochondria. For example, in one aspect, a heterologous nucleic acid encoding a *Candida viswanathii* cytoplasmic carnitine acetyltransferase (YAT1) with added nucleotides encoding a peroxisomal targeting sequence (e.g, a PTS1 sequence such as AKL or SKL, or slight variant thereof (PKL, PKF)) can be introduced into a host cell or microorganism (e.g., a *Candida viswanathii* cell). A nucleotide sequence encoding (and the amino acid sequence of) a *Candida viswanathii* YAT1$^{+pts}$p are provided herein (nucleotide SEQ ID NO: 70 and amino acid SEQ ID NO: 13). Additional non-limiting examples of nucleic acids encoding cytoplasmic carnitine acetyltransferase include *Saccharomyces cerevisiae* YAT1 (Genbank accession number X74553), *Aspergillus nidulans* FacC (Genbank accession number AF023156), *Cyberlindnera jadinii* YAT1 (Genbank accession number AB641829), *Candida dubliniensis* YAT1 (Genbank accession number XM_002416790) and *Candida albicans* (Genbank accession number AF525683).

A sequence of nucleotides encoding a peroxisomal targeting sequence can be added to the 3' end of the coding sequence of any such nucleic acid using methods as described herein.

The peroxisomal carnitine acetyltransferase activities of host and modified cells and microorganisms can be evaluated and monitored using methods known in the art. For example, methods of isolating peroxisomal and mitochondrial components of yeast cells and of extracting carnitine acetyltransferase from subcellular fractions have been described by Ueda et al. [(1982) *Eur. J. Biochem.* 124:205-210] and Kozulic et al. [(1987) *Eur. J. Biochem.* 168:245-250]. Methods of measuring the enzymatic activity of carnitine acetyltransferase are also known in the art, see, e.g., Fritz and Schultz (1965) *J. Biol. Chem.* 240:2188-2192; Chase (1969) *Meth. Enzymol.* 13:387-393. Nucleic acid sequences representing native and/or modified peroxisomal carnitine acetyltransferase-encoding sequences also can be detected using nucleic acid detection methods (e.g., PCR, primer extension, nucleic acid hybridization, the like and combinations thereof), or the amounts of the nucleic acids or encoded proteins can be assessed using quantitative expression based analysis (e.g., RT-PCR, western blot analysis, northern blot analysis, the like and combinations thereof), where the engineered cells or organisms exhibit increased or decreased RNA and/or polypeptide levels as compared to the host cell or organism.

In other embodiments, the amount and/or activity of a host peroxisomal carnitine acetyltransferase can be increased, for example, by increasing the number of copies of a gene encoding a peroxisomal carnitine acetyltransferase (e.g., 1, 2, 3, 4, 5, 6, 7, 8, 9, 10, 15, 20, 25 or more copies of the gene), by increasing the activity of a promoter that regulates transcription of a gene encoding a peroxisomal carnitine acetyltransferase, or by increasing the number of copies of a gene encoding a peroxisomal carnitine acetyltransferase and increasing the activity of a promoter that regulates transcription of a gene encoding a peroxisomal carnitine acetyltransferase. In some embodiments, a peroxisomal carnitine acetyltransferase is endogenous to the host cell or microorganism.

Modification of Acetyl-CoA Synthetase

Acetyl-CoA synthetase (EC 6.2.1.1) is an enzyme that can catalyze the ligation of acetate and coenzyme A to produce acetyl-CoA. In many cells and organisms, the enzyme is encoded by one or more ACS genes. For example, in some yeast, acetyl-CoA synthetase is encoded by two genes, ACS1 and ACS2, which may be differentially expressed in response to growth on differing carbon sources. In some cells, the proteins encoded by the two genes may also be differentially distributed within the nucleus, mitochondria, peroxisomes and cytoplasm of cells. Acs1p and Acs2p are expressed in the cytoplasm, but, in some cells, only Acs2p is present when cells are grown in glucose. ACS1 expression may be repressed in some cells grown in glucose and derepressed when glucose is limited and/or in the presence of non-fermentable carbon sources, e.g., acetate and ethanol. Generally, ACS2 is constitutively expressed in yeast cells. In some instances, the affinity of Acs1p for acetate may be higher, e.g, about 30-fold higher, than that of Acs2p.

Provided herein are cells, microorganisms, compositions and methods in which the amount and/or activity of acetyl-CoA synthetase (also referred to as ACS or acetate-CoA ligase and used interchangeably herein) in a cell is modified. For example, in some aspects, a cell or microorganism may be modified to increase the amount of acetyl-CoA synthetase and/or acetyl-CoA synthetase activity, may be modified to decrease the amount of acetyl-CoA synthetase and/or acetyl- CoA synthetase activity, or may be modified to alternately increase and decrease the amount of acetyl-CoA synthetase and/or acetyl-CoA synthetase activity depending, for example, on the cellular location(s) of the enzyme and/or on the conditions in which the modified cell or microorganism is cultured.

For example, in embodiments in which modification of cellular acetate generation yields increased amounts of cytosolic acetate, the amount and/or activity of cytosolic acetyl-CoA synthetase can also be increased to provide for increased conversion of acetate to acetyl-CoA. Heterologous nucleic acid encoding Acs1p and/or Acs2p can be introduced into a host cell to increase the amount of cytosolic acetyl-CoA synthetase. For example, the amount and/or activity of a host cytosolic acetyl-CoA synthetase can be increased by increasing the number of copies of a gene encoding a cytosolic acetyl-CoA synthetase (e.g., 1, 2, 3, 4, 5, 6, 7, 8, 9, 10, 15, 20, 25 or more copies of the gene), by increasing the activity of a promoter that regulates transcription of a gene encoding a cytosolic acetyl-CoA synthetase, or by increasing the number of copies of a gene encoding a cytosolic acetyl-CoA synthetase and increasing the activity of a promoter that regulates transcription of a gene encoding a cytosolic acetyl-CoA synthetase. In some embodiments, a cytosolic acetyl-CoA synthetase is endogenous to the host cell or microorganism. Additionally, a heterologous promoter can be used to regulate expression of a recombinant acetyl-CoA synthetase-encoding nucleic acid. An example of one such heterologous promoter is a fatty acid-inducible promoter that can provide for increased acetyl-CoA synthetase expression, particularly when exposed to fatty acids as a carbon source. Such promoter elements include those that regulate expression of peroxisomal proteins and/or β-oxidation enzymes in microbes, e.g., a *Candida* hydratase-dehydrogenase-epimerase (HDE) gene promoter.

In other aspects, the amount and/or activity of acetyl-CoA synthetase in a cell is decreased. Methods for decreasing acetyl-CoA synthetase activity in a cell include, but are not limited to, modifying the amount of acetyl-CoA synthetase protein expression in the cell, for example, by replacing the wild-type promoter of an endogenous acetyl-CoA synthetase gene in an organism with a weaker heterologous promoter, deleting or disrupting an endogenous gene, and/or replacing or modifying a gene encoding a wild-type acetyl-CoA synthetase such that the encoded modified or substituted acetyl-CoA synthetase protein has a reduced enzyme activity. For example, in some instances, it may be desirable to decrease the amount and/or activity of a peroxisomal protein having acetyl-CoA synthetase activity.

In a particular embodiment, the acetyl-CoA synthetase enzyme can be a *Candida* yeast protein. Examples of *Candida viswanathii* nucleotide sequences (and corresponding amino acid sequences) encoding acetyl-CoA synthetase are provided herein (nucleotide SEQ ID NOS: 76 and 77 and amino acid SEQ ID NOS: 20 and 21). Additional examples of nucleotide sequences encoding acetyl-CoA synthetase proteins include, but are not limited to: *Saccharomyces cerevisiae* ACS1 (Genbank accession number NM_001178197), *Saccharomyces cerevisiae* ACS2 (Genbank accession number NM_001182040), *Candida tropicalis* ACS1 (Genbank accession number XM_002547679), *Candida albicans* ACS2 (Genbank accession number AF535132), *Cyberlindnera jadinii* ACS1 (Genbank accession number AB641819), *Cyberlindnera jadinii* ACS2 (Genbank accession number AB641820), *Kluyveromyces lactis* ACS2 (Genbank accession number AF134491).

The acetyl-CoA synthetase activities of host and modified cells and microorganisms can be evaluated and monitored using methods known in the art. Examples of acetyl-CoA synthetase activity assays include a continuous coupled enzymatic assay (see, e.g., Castano-Cerezo et al. (2012) *Bio-protocol* 2(17) and Frenkel and Kitchens (1977) *J. Biol. Chem.* 252(2): 504-507). Nucleic acid sequences representing native and/or modified acetyl-CoA synthetase-encoding sequences also can be detected using nucleic acid detection methods (e.g., PCR, primer extension, nucleic acid hybridization, the like and combinations thereof), or the amounts of the nucleic acids or encoded proteins can be assessed using quantitative expression based analysis (e.g., RT-PCR, western blot analysis, northern blot analysis, the like and combinations thereof), where the engineered cells or organisms exhibit increased or decreased RNA and/or polypeptide levels as compared to the host cell or organism.

Modification of Citrate Processing

Carbon atoms of acetyl groups in mitochondrial acetyl-CoA can also be captured from intermediates of the TCA cycle such as, for example, citrate molecules generated in the first step of the cycle through the citrate synthase-catalyzed condensation of acetyl-CoA and oxaloacetate. Under certain conditions, citrate can be transported from mitochondria into the cytoplasm via a mitochondrial inner membrane citrate transport protein (CTP). This transport protein provides for the efflux of citrate from mitochondria generally in exchange for the influx of a carboxylate molecule (e.g., malate) from the cytosol. Cytosolic citrate can be converted to isocitrate which can serve as a substrate in the NADPH-generating oxidation reaction through which it is converted to α-ketoglutarate. Some yeast, typically oleaginous yeast, express an endogenous ATP citrate lyase which can catalyze the cleavage of citrate into oxaloacetate and acetyl-CoA. Thus, in such instances, cytosolic citrate can serve as a source of acetyl carbons that can be converted to acetyl-CoA. In general, yeast ATP citrate lysate is a dimer and can be heterodimeric (e.g., Acl1p/Acl2p) or homomeric.

In another embodiment of the cells and microorganisms, target molecule production systems and methods provided herein, carbon atoms incorporated into citrate that has been transferred to the cytosol can be captured through the cleavage of citrate to oxaloacetate and acetyl-CoA by the enzyme ATP citrate lyase (i.e., ACL, used interchangeably herein; e.g., EC 2.3.3.8). The capture of metabolite carbon in this manner can divert it from use in other metabolic processes and also can result in an increase in the level cytoplasmic acetyl-CoA. In one aspect of this embodiment, the amount and/or activity of ATP citrate lyase in the cytosol of modified cells is increased relative to the unmodified host cell. The amount and/or activity of a host ATP citrate lyase can be increased, for example, by introducing and/or increasing the number of copies of a gene encoding an ATP citrate lyase (e.g., 1, 2, 3, 4, 5, 6, 7, 8, 9, 10, 15, 20, 25 or more copies of the gene), by increasing the activity of a promoter that regulates transcription of a gene encoding an ATP citrate lyase, or by increasing the number of copies of a gene encoding an ATP citrate lyase and increasing the activity of a promoter that regulates transcription of a gene encoding an ATP citrate lyase. In some embodiments, an ATP citrate lyase is endogenous to the host cell or microorganism. In other embodiments, a host cell or microorganism does not express an endogenous cytosolic ATP citrate lyase.

Thus, for example, heterologous nucleic acids encoding an ATP citrate lyase can be introduced into a host cell or microorganism to provide for an increased amount and/or activity of cytosolic ATP citrate lyase. In a particular embodiment, the ATP citrate lyase enzyme encoded by the heterologous nucleic acid can be an oleaginous yeast protein. An example of an oleaginous yeast ATP citrate lyase is formed by the *Yarrowia lipolytica* Acl1 and Acl2 proteins. Examples of *Y. lipolytica* Acl1p and Acl2p amino acid sequences are provided herein (SEQ ID NOS: 42 and 43). If a host cell or microorganism is a different species than the heterologous ATP citrate lyase that will be expressed in the host, it can be desirable to introduce nucleic acids encoding the ATP citrate lyase proteins that have been optimized for codons used in the host species. As a non-limiting example, the nucleotide sequences encoding *Yarrowia lipolytica* Acl1p and Acl2p that have been optimized for expression in a different yeast species (*Candida viswanathii*) are provided herein (SEQ ID NOS: 96 and 97). Additional examples of nucleotide sequences encoding ATP citrate lyase proteins include, but are not limited to: *Phaffia rhodozyma* ACL1 and ACL2 (Genbank accession numbers KM503045, KM510496) and *Sordaria macrospora* ACL1 and ACL2 (Genbank accession numbers AJ224922, XM_003344949).

The promoter used for regulating transcription of a heterologous nucleic acid encoding an ATP citrate lyase can also be modified. For example, the amount of an ATP citrate lyase protein expressed in a cell may be increased by including in the heterologous nucleic acid a strong heterologous promoter and/or a promoter that provides for a different pattern of expression in the cell or microorganism. An example of one such heterologous promoter is a fatty acid-inducible promoter that can provide for increased ATP citrate lyase expression, particularly when exposed to fatty acids as a carbon source. Such promoter elements include those that regulate expression of peroxisomal proteins and/or β-oxidation enzymes in microbes, e.g., a *Candida* hydratase-dehydrogenase-epimerase (HDE) gene promoter.

ATP citrate lyase activity can be determined using assays known in the art and/or described herein. Such assays include, for example, methods described by Linn and Srere [(1979) *J. Biol. Chem.* 254:1691-1698] and Pentyala and Benjamin [(1995) *Biochemistry* 34:10961-10969]. Nucleic acid sequences representing native and/or modified ATP citrate lyase-encoding sequences also can be detected using nucleic acid detection methods (e.g., PCR, primer extension, nucleic acid hybridization, the like and combinations thereof), or the amounts of the nucleic acids or encoded proteins can be assessed using quantitative expression based analysis (e.g., RT-PCR, western blot analysis, northern blot analysis, the like and combinations thereof), where the engineered cells or organisms exhibit increased or decreased RNA and/or polypeptide levels as compared to the host cell or organism.

In some embodiments of the cells, organisms and methods provided herein involving capture of acetyl carbons from cytosolic citrate, it may be beneficial to increase the amount of citrate in the cytosol. One approach to increasing cytosolic citrate levels is by increasing efflux of citrate from mitochondria into the cytosol. One method of increasing mitochondrial citrate efflux involves increasing the amount and/or activity of citrate transporter protein (CTP) in mitochondria of the modified cells. The amount and/or activity of a host citrate transporter protein can be increased, for example, by introducing and/or increasing the number of copies of a gene encoding a mitochondrial citrate transporter (e.g., 1, 2, 3, 4, 5, 6, 7, 8, 9, 10, 15, 20, 25 or more copies of the gene), by increasing the activity of a promoter that regulates transcription of a gene encoding a mitochondrial citrate transporter, or by increasing the number of copies of a gene encoding a mitochondrial citrate transporter and increasing the activity of a promoter that regulates transcription of a gene encoding a mitochondrial citrate transporter. In some embodiments, a mitochondrial citrate transporter is endogenous to the host cell or microorganism.

Thus, for example, heterologous nucleic acids encoding a mitochondrial citrate transporter can be introduced into a host cell or microorganism to provide for an increased amount and/or activity of a mitochondrial citrate transporter. In a particular embodiment, the mitochondrial citrate transporter encoded by the heterologous nucleic acid can be a yeast protein. If a host cell or microorganism is a different species than the heterologous mitochondrial citrate transporter that will be expressed in the host, it can be desirable to introduce nucleic acids encoding the mitochondrial citrate transporter that have been optimized for codons used in the host species. Examples of nucleotide sequences encoding a protein that may have mitochondrial citrate transporter activity include, but are not limited to: *Candida albicans* CTP1 (Genbank accession number XM_019475315), *Candida orthopsilosis* CTP1 (Genbank accession number XM_003868562), *Saccharomyces cerevisiae* CTP1 (Genbank accession number NM_001178639) and *Candida tropicalis* (Genbank accession number XM_002548023).

Modification of Acyl-CoA Formation, Hydrolysis and Use

Acyl-CoA is a molecule containing a carboxylic acid and coenzyme A joined through a thioester bond. In cells, acyl-CoA can be generated from carboxylic acids entering the cytosol from the extracellular environment, fatty acids synthesized within cells, lipid sidechains resulting from membrane turnover, products of the hydrolysis of triglyceride and sterol esters and carboxylation of acetyl-CoA. Acyl-CoA participates in multiple cellular pathways including lipid synthesis, β-oxidation, fatty acid synthesis and protein acylation. One reaction through which acyl-CoA is formed is the condensation between a thiol group of coenzyme A and a carboxy group of a carboxylic acid. This reaction between a fatty acid and coenzyme A is referred to as activation of the free fatty acid and can be catalyzed by an acyl-CoA synthetase enzyme (e.g. EC 6.2.1.3). A short-chain acyl-CoA, for example, malonyl-CoA, can also be generated through carboxylation of acetyl-CoA in a reaction catalyzed by an acetyl-CoA carboxylase (e.g., EC 6.4.1.2). Conversely, free fatty acids can be liberated from acyl-CoA through the action of a thioesterase (e.g., EC 3.1.2.20). Because acyl-CoA is a major carrier molecule of cellular carbons, its formation and hydrolysis represent certain aspects of methods of modifying carbon flux in cells.

Modification of Acyl-CoA Synthetase Activity

Acyl-CoA synthetases (also referred to as fatty acid or acyl Co-A ligases and used interchangeably herein), are a family of enzymes in the enzyme classification subgroup 6.2.1 with varying substrate affinities, expression patterns and cellular localizations. In many microorganisms, there are multiple, distinct genes encoding separate acyl-CoA synthetases. Many yeast species (e.g., *Candida* spp. and *Saccharomyces* spp.) have five or six or more acyl-CoA synthetase genes encoding distinct enzymes. For example, *Saccharomyces cerevisiae* has 4 FAA genes (FAA1, FAA2, FAA3 and FAA4) and 2 FAT genes (FAT1 and FAT2) encoding acyl-CoA synthetase enzymes. Generally, FAA gene-encoded enzymes catalyze activation of acyl chains containing about 8-20 carbon atoms whereas the enzyme encoded by FAT1 typically catalyzes activation of acyl chains containing 20 or more carbon atoms. Faa1p and Faa4p, which tend to be located in the cytosol and associated with membranes, are involved in activation of fatty acids internalized into cells from the extracellular medium and intracellular fatty acids arising from degradation of lipids, triacylglycerides and steryl esters. The Faa1p isozyme can exhibit broad substrate chain-length specificity, represents 90% of the cellular acyl-CoA synthetase activity, and is localized in the cytosolic and microsomal fractions. Faa4p has broad chain-length specificity and has been shown to be important in protein myristoylation. Faa2p is localized to peroxisomes, has broad chain-length specificity, and participates in activation of fatty acids occurring during β-oxidation. Fat1p is typically a dual function protein localized to the cellular membrane that has activity for both fatty acid transport and fatty acid activation. Fat2p tends to be targeted to the peroxisomal membrane for medium chain fatty acid transport and activation.

Homologs for FAA1 and FAT1 have been identified in Candida strains. Acyl-CoA synthetase has six isoforms encoded by FAA1, FAT1, ACS2A, ACS2B, ACS2C and ACS2D, respectively, in Candida spp. (e.g., homologous to FAA1, FAT1, and FAA2 in S. cerevisiae). Two of the homologs display 95% identity to one another and are most likely alleles of the same gene. Four FAA2 homologs have been identified in Candida strain ATCC 20336 (also referred to in the art as acyl-CoA synthetase-encoding genes ACS2A through ACS2D in Candida). Examples of Candida viswanathii nucleotide sequences (and corresponding amino acid sequences) encoding acyl-CoA synthetases are provided herein (nucleotide SEQ ID NOS: 91 and 98 and amino acid SEQ ID NOS: 35 and 44) and in International patent application no. PCT/US2012/045615 (publication no. WO 2013/106730). Acetyl-CoA synthetase-encoding genes are also referred to as ACS genes, as described herein. For clarity, acyl-CoA synthetase-encoding genes are referred to as FAA or FAT herein and not as ACS genes (which herein refer to acetyl-CoA synthetase-encoding genes).

In some embodiments of the microorganisms, compositions and methods provided herein, the amount and/or activity of acyl-CoA synthetase in a cell is modified. For example, in some aspects, a cell or microorganism may be modified to increase acyl-CoA synthetase and/or acyl-CoA synthetase activity, may be modified to decrease acyl-CoA synthetase and/or acyl-CoA synthetase activity, or may be modified to alternately increase and decrease acyl-CoA synthetase and/or acyl-CoA synthetase activity depending, for example, on the cellular location(s) of the enzyme and/or on the conditions in which the modified cell or microorganism is cultured.

In certain aspects, the amount and/or activity of an acyl-CoA synthetase in a cell is decreased. Reducing or eliminating the amount and/or activity of an acyl-CoA synthetase may be particularly beneficial in embodiments in which the flux of carbons from fatty acids is directed toward a particular target product pathway and away from other cellular metabolic pathways involving activated fatty acids. When free internalized or cytosolic fatty acids are activated by acyl-CoA synthetase and used in cellular processes, such as lipid biosynthesis, the carbon atoms in the free fatty acids are not available for use in the cell or microorganism production of commercially important chemicals. Without being limited by theory, it is believed that reduction in the amount of fatty-acyl-CoA available for various cellular processes can increase the amount of fatty acids available for conversion into target molecules, for example, a fatty dicarboxylic acid (e.g., adipic acid, suberic acid, sebacic acid and dodecanedioic acid) by other engineered pathways in the same host cell or organism (e.g., omega oxidation pathway, beta oxidation pathway, omega oxidation pathway and beta oxidation pathway).

In some embodiments, one strategy is to control the subcellular location of acyl-CoA synthetase enzyme activity so that it is present only in the peroxisome. FAA1 and FAT1 mutants, faa1Δ and fat1Δ, of Candida were constructed and should have very little acyl-CoA synthetase activity targeted to the cytoplasm. In these mutant strains, exogenously supplied long-chain free fatty acids tend to accumulate in the cytoplasm since they cannot be transported into the peroxisome unless they are activated to the acyl-CoA thioester. High concentrations of free fatty acid can be toxic, so the cell acts to detoxify itself by oxidizing the free fatty acids to dicarboxylic acids that are much less toxic. Unlike long-chain fatty acids, long-chain dicarboxylic acids are able to diffuse into the peroxisomal compartment where they can then be activated to diacyl-CoA thioesters and enter into the beta-oxidation pathway. With multiple peroxisomal acyl-CoA synthetase isozymes it may be that each isozyme has different substrate specificity. In some embodiments, it is desired to retain those peroxisomal acyl-CoA synthetase enzymes with substrate specificity matching the chain-length of the fatty acid feedstock but without activity (or low activity) on diacids of chain-length 6, 8, 10, 12, 14, 16, 18 or 20 carbons. With this strategy, any long-chain dicarboxyl-CoA that is chain-shortened by beta-oxidation to 12 carbons, for example, that is subsequently hydrolyzed to a dicarboxylic acid and free CoA cannot be reactivated to a dicarboxyl-CoA for re-entry into beta-oxidation for further chain shortening. In some embodiments, in combination with controlling the substrate chain-length specificity of the peroxisomal acyl-CoA synthetase, a peroxisomal thioesterase activity is amplified with maximum activity at the desired chain-length of a target product. This strategy can control the chain-length of the dicarboxylic acid produced by beta-oxidation.

Certain aspects of the microorganisms, compositions and methods provided herein include one or more modifications to reduce or eliminate cytosolic activation of free fatty acids into acyl-CoA. One approach to reducing or eliminating cytosolic free fatty acid activation is to decrease the amount and/or activity of an acyl-CoA synthetase. For example, endogenous microbial genes encoding one or more acyl-CoA synthetases (e.g., yeast FAA1, FAA4 and/or FAT1 gene) can be disrupted or deleted in a host cell or microorganism to reduce or eliminate acyl-CoA synthetase activity in the host relative to a cell or microorganism in which the gene(s) have not been modified. Methods for decreasing the amount and/or activity of one or more acyl-CoA synthetases, such as acyl-CoA synthetases involved in activation of cytosolic free fatty acids, in a cell include, but are not limited to, modifying the amount of acyl-CoA synthetase protein expression in the cell, for example, by replacing the wild-type promoter of an endogenous acyl-CoA synthetase gene in a cell or organism with a weaker heterologous promoter, deleting or disrupting an endogenous gene, and/or replacing or modifying a gene encoding a wild-type acyl-CoA synthetase such that the encoded modified or substituted acyl-CoA synthetase protein has a reduced enzyme activity. For example, expression of a host acyl-CoA synthetase activity can be decreased or eliminated by disruption (e.g., knockout, insertion mutagenesis, the like and combinations thereof) of a host gene encoding the protein, or by decreasing the activity of the promoter (e.g., through addition of repressor sequences to the promoter or 5'UTR or replacing the promoter) that controls transcription of an acyl-CoA synthetase gene using recombinant molecular biology techniques known in the art and/or described herein. In one embodiment, a diploid yeast, such as, for example, a *Candida* yeast, when used as a host microorganism can be subjected to genetic modification in which one of the two alleles of an acyl-CoA synthetase gene is disrupted or deleted. In so doing, a single allele of the gene remains for a reduced amount of acyl-CoA synthetase expression in the microorganism and a reduced amount of the protein in the cell.

One method for disrupting an endogenous acyl-CoA synthetase gene is by recombinantly inserting a heterologous nucleic acid (e.g., a nucleotide sequence encoding a selectable marker such as an enzyme that restores an auxotrophic host organism to prototrophy) into the endogenous gene, thereby generating an engineered organism deficient in acyl-CoA synthetase activity. This can be done, for example, through homologous recombination in which a heterologous nucleic acid containing sequences of an endogenous acyl-CoA synthetase gene and a disrupting sequence (e.g., a knock-out gene cassette such as described herein) is introduced into a host cell or microorganism. Nucleic acids encoding an acyl-CoA synthetase can be obtained from a number of sources, including, for example, yeast cells. Genomic DNA from cell sources can be amplified using oligonucleotide primers based on the nucleotide sequence of an acyl-CoA synthetase encoding gene, including examples provided herein. Nucleotide sequences encoding (and the amino acid sequences of) *Candida viswanathii* acyl-CoA synthetase Faa1p and Fat1p are provided herein (nucleotide SEQ ID NOS: 91 and 98 and amino acid SEQ ID NOS: 35 and 44). Additional non-limiting examples of nucleic acids encoding acyl-CoA synthetases include *Saccharomyces cerevisiae* FAA1 (Genbank accession numbers NM_001183737 and M96371), *Saccharomyces cerevisiae* FAA4 (Genbank accession number NM_001182754), *Saccharomyces cerevisiae* FAA2 (Genbank accession number NM_001178906), *Saccharomyces cerevisiae* FAA3 (Genbank accession number NM_001179359), *Yarrowia lypolytica* YAL1 (Genbank accession number XM_502959), *Yarrowia lypolytica* FAT1 (Genbank accession number NC_006071), *Candida albicans* FAA4 (Genbank accession number XM_714261), *Aspergillus nomius* FAA4 (Genbank accession number XM_015551345), *Coccidioides immitis* FAA4 (Genbank accession number XM_001240655) and *Aspergillus niger* FAA4 (Genbank accession number XM_001397786).

In other embodiments, the amount and/or activity of a host acyl-CoA synthetase can be increased, for example, by increasing the number of copies of a gene encoding an acyl-CoA synthetase (e.g., 1, 2, 3, 4, 5, 6, 7, 8, 9, 10, 15, 20, 25 or more copies of the gene), by increasing the activity of a promoter that regulates transcription of a gene encoding an acyl-CoA synthetase, or by increasing the number of copies of a gene encoding an acyl-CoA synthetase and increasing the activity of a promoter that regulates transcription of a gene encoding an acyl-CoA synthetase. In some embodiments, an acyl-CoA synthetase is endogenous to the host cell or microorganism. In particular embodiments, the amount and/or activity of a host peroxisomal acyl-CoA synthetase is increased.

The presence, absence or amount of acyl-CoA synthetase activity can be detected by any suitable method known in the art. Non-limiting examples of suitable detection methods include enzymatic assays (e.g., Lageweg et al. (1991) *Anal. Biochem.* 197(2):384-388, Erland et al. (2001) *Anal. Biochem.* 295(1):38-44), PCR based assays (e.g., qPCR, RT-PCR), immunological detection methods (e.g., antibodies specific for acyl-CoA synthetase), the like and combinations thereof. Methods for determining acyl-CoA synthetase activities also include assays described by Trigatti et al. [(1992) *Biochem. Cell. Biol.* 70:76-80] and Kamiryo et al. [(1977) *Proc. Natl. Acad. Sci. USA* 74:4947-4950].

Modification of Acetyl-CoA Carboxylase Activity

Malonyl-CoA is a coenzyme A derivative of the dicarboxylic acid malonic acid that can serve as a precursor in the synthesis of numerous valuable organic molecules, including fatty acids and polyketides. In the cytosol, malonyl-CoA can be generated by carboxylation of acetyl-CoA through the addition of $CO_2$ (e.g., derived from bicarbonate) in a reaction catalyzed by the enzyme acetyl-CoA carboxylase (e.g., EC 6.4.1.2). Acetyl-CoA carboxylase sometimes is also referred to as "acetyl-CoA:carbon-dioxide ligase (ADP-forming)" and "acetyl coenzyme A carboxylase". In eukaryotes, acetyl-CoA carboxylase is a multifunctional polypeptide containing a biotin carrier protein domain, a biotin carboxylase domain and a carboxyl-transferase domain. Biotin joined to the biotin carrier protein is a co-factor in malonyl-CoA formation. It receives $CO_2$ which becomes attached to it at a biotin ring nitrogen in an ATP-dependent reaction catalyzed by the biotin carboxylase of the acetyl-CoA carboxylase. The activated $CO_2$ is then transferred from biotin to acetyl-CoA by the carboxyl-transferase domain to form malonyl-CoA. Malonyl-CoA can serve as a carbon donor in the synthesis of a fatty acid chain in repeated cycles of the addition of 2 carbon atoms per cycle to extend the chain and generate a fatty acid. The reactions of each cycle are catalyzed by fatty acid synthase (FAS) and continue until typically a 16-carbon fatty acid (palmitic acid) or 18-carbon fatty acid (stearic acid) is completed in the form of palmitoyl-CoA or stearoyl-CoA, respectively. Accordingly, a supply of malonyl-CoA, and/or precursors and enzymes (e.g., acetyl-CoA carboxylase) that generate malonyl-CoA, can be required for fatty acid synthesis.

In some embodiments of the cells, microorganisms, compositions and methods provided herein, the amount and/or activity of acetyl-CoA carboxylase in a cell is modified. For example, in some aspects, a cell or microorganism may be modified to increase acetyl-CoA carboxylase and/or acetyl-CoA carboxylase activity, may be modified to decrease acetyl-CoA carboxylase and/or acetyl-CoA carboxylase activity, or may be modified to alternately increase and decrease acetyl-CoA carboxylase and/or acetyl-CoA carboxylase activity depending, for example, on the target molecule(s) produced and/or on the conditions in which the modified cell or microorganism is cultured.

A modification of cellular carbon flux that increases cytosolic acetyl-CoA alone may not be optimal for enhancing fatty acid or other target molecule production in an engineered, cell-based or microbial system if there is not a concurrent increase in conversion of acetyl-CoA to malonyl-CoA. To maximize production efficiencies, included in the cells, microorganisms, compositions and methods provided herein are cellular carbon flux modifications that increase the amount of cytosolic malonyl-CoA. In one embodiment, the amount and/or activity of acetyl-CoA carboxylase is increased in the cytosol to direct carbon flux towards generation of malonyl-CoA.

The amount and/or activity of a host acetyl-CoA carboxylase can be increased, for example, by increasing the number of copies of a gene encoding an acetyl-CoA carboxylase (e.g., 1, 2, 3, 4, 5, 6, 7, 8, 9, 10, 15, 20, 25 or more copies of the gene), by increasing the activity of a promoter that regulates transcription of a gene encoding an acetyl-CoA carboxylase, or by increasing the number of copies of a gene encoding an acetyl-CoA carboxylase and increasing the activity of a promoter that regulates transcription of a gene encoding an acetyl-CoA carboxylase. In some embodiments, an acetyl-CoA carboxylase is endogenous to the host cell or microorganism. An acetyl-CoA carboxylase activity may be amplified by over-expression of an acetyl-CoA carboxylase gene by any suitable method. Non-limiting examples of methods suitable to amplify or over express a gene include amplifying the number of acetyl-CoA carboxylase genes in yeast, for example, following transformation with a high-copy number plasmid (e.g., such as one containing a 2u origin of replication), integration of multiple copies of the gene into the host genome, over-expression of the gene directed by a strong promoter, the like or combinations thereof. An acetyl-CoA carboxylase gene may be native to Candida tropicalis or Candida viswanithii, for example, or it may be obtained from a heterologous source. Examples of a Candida viswanathii acetyl-CoA carboxylase polypeptide amino acid sequence (Acc1p), and nucleotide sequence encoding it (ACC1), are provided herein (nucleotide SEQ ID NO: 74 and amino acid SEQ ID NOS: 18 and 19). Additional non-limiting examples of nucleic acids encoding an acetyl-CoA carboxylase include Yarrowia lypolytica ACC1 (Genbank accession NC_006069), Saccharomyces cerevisiae ACC1 (Genbank accession NM_001183193), Candida tropicalis ACC (Genbank accession number XM_002546179), Candida albicans ACC1 (Genbank accession number XM_713531), Aspergillus nidulans ACCA (Genbank accession number Y15996), Aspergillus niger ACCA (Genbank accession number XM_001395439), Aspergillus oryzae ACC (Genbank accession number XM_001826359), Schizosaccharomyces pombe ACC (Genbank accession D78169), Neurospora crassa ACC (Genbank accession XM_957924), Lipomyces starkeyi ACC1 (Genbank accession KJ948118), Debaryomyces hansenii ACC1 (Genbank accession XM_457211), Amylomyces rouxii ACC (Genbank accession EF397565) and Coccidioides immitis ACC (Genbank accession number XM_001247055).

The promoter used for regulating transcription of a heterologous nucleic acid encoding an acetyl-CoA carboxylase can also be modified. For example, the amount of an acetyl-CoA carboxylase protein expressed in a particular cellular location may be increased by including in the heterologous nucleic acid a strong heterologous promoter and/or a promoter that provides for a different pattern of expression in the cell or microorganism. An example of one such heterologous promoter is a fatty acid-inducible promoter that can provide for increased acetyl-CoA carboxylase expression, particularly when exposed to fatty acids as a carbon source. Such promoter elements include those that regulate expression of peroxisomal proteins and/or β-oxidation enzymes in microbes, e.g., a Candida hydratase-dehydrogenase-epimerase (HDE) gene promoter. The nucleotide sequence of a Candida viswanathii HDE gene promoter is provided herein as are examples of additional fatty acid-inducible promoters.

The reverse activity (e.g., decarboxylation of malonyl-CoA) is carried out by a separate enzyme, malonyl-CoA decarboxylase. In some embodiments, to further increase carbon flux through a particular reaction or through a metabolic pathway, one or more reverse activities in the pathway can be altered to inhibit the back conversion of a desired product into its starting reactants. In certain embodiments, a malonyl-CoA decarboxylase activity is reduced or eliminated to further increase the carbon flux through an acetyl-CoA carboxylase activity in the direction of malonyl-CoA production.

Acetyl-CoA carboxylase is regulated by feedback inhibition of acyl-CoA (e.g., palmitoyl-CoA) and by phosphorylation. As such, increasing the copy number of acetyl-CoA carboxylase-encoding nucleic acids in a cell may not alone be sufficient in increasing the acetyl-CoA carboxylase activity in the cell. Because the dephosphorylated state is the active state of the enzyme, one approach for increasing the activity of acetyl-CoA carboxylase is to reduce or eliminate phosphorylation of the protein. Provided herein are modified acetyl-CoA carboxylase proteins (and mutant nucleic acids encoding the proteins) in which one or more phosphorylatable serine residues have been substituted with alanine residues thereby relieving the regulation by phosphorylation. In a particular embodiment, the modified acetyl-CoA carboxylase is a modified yeast enzyme. For example, as described herein, an endogenous Candida viswanathii acetyl-CoA carboxylase wild-type enzyme was modified to substitute alanine residues for one or more of the following serine amino acid residues: S652, S1131, S1138, S1153, S1158. The modified amino acid sequences are provided herein. Also provided herein are cells and microorganisms containing heterologous nucleic acid encoding a modified acetyl-CoA carboxylase protein and methods of increasing cytosolic malonyl-CoA generation and producing organic acids and other target products using the compositions provided herein. In another aspect of this embodiment, the amount and/or activity of acetyl-CoA carboxylase is increased in the cytosol of modified cells relative to an unmodified host cell by introducing multiple copies of the modified heterologous nucleic acid encoding acetyl-CoA carboxylase into a host cell to provide for increased acetyl-CoA carboxylase protein and/or by increasing the expression of the modified acetyl-CoA carboxylase in the cell through the use of a strong heterologous promoter.

In other aspects, the amount and/or activity of acetyl-CoA carboxylase in a cell is decreased. Methods for decreasing acetyl-CoA carboxylase activity in a cell include, but are not limited to, modifying the amount of acetyl-CoA carboxylase protein expression in the cell, for example, by replacing the wild-type promoter of an endogenous acetyl-CoA carboxylase gene in an organism with a weaker heterologous promoter, deleting or disrupting an endogenous gene, and/or replacing or modifying a gene encoding a wild-type acetyl-CoA carboxylase such that the encoded modified or substituted acetyl-CoA carboxylase protein has a reduced enzyme activity.

The presence, absence or amount of acyl-CoA carboxylase activity can be detected by any suitable method known in the art. Non-limiting examples of suitable detection methods include radioactive $HCO_3^-$ incorporation assays and coupled enzyme assays (e.g., Diacovich et al. (2002) J. Biol. Chem. 277(34):31228-31236), PCR based assays (e.g., qPCR, RT-PCR), immunological detection methods (e.g., antibodies specific for acyl-CoA carboxylase), the like and combinations thereof.

Modification of Thioesterase Activity

A thioesterase is an enzyme that catalyzes the hydrolysis of a thioester bond between a carbonyl group and a sulfur atom. In cells, certain thioesterases (e.g., acyl-CoA thioesterase activity, acyl-ACP thioesterase activity) catalyze the removal of Coenzyme A or acyl carrier protein (e.g., ACP) from a fatty acid yielding a free fatty acid and unesterified carrier, e.g., Coenzyme A (CoASH). The reaction occurs in the presence of water, and Coenzyme A or acyl carrier protein is specifically removed at a thiol group. The released CoA can then be reused for other cellular activities. A non-limiting example of an enzyme with thioesterase activity is acyl-CoA hydrolase (e.g., EC 3.1.2.20; also referred to as acyl coenzyme A thioesterase, acyl-CoA thioesterase, acyl coenzyme A hydrolase, thioesterase B, thioesterase II, lecithinase B, lysophopholipase L1, acyl-CoA thioesterase 1, and acyl-CoA thioesterase). In eukaryotic microorganisms, acyl-CoA thioesterases are generally localized in peroxisomes but may also occur in mitochondria.

In some embodiments of the cells, microorganisms, compositions and methods provided herein, the amount and/or activity of a thioesterase in a cell is modified. For example, in some aspects, a cell or microorganism may be modified to increase the amount of thioesterase and/or thioesterase activity, may be modified to decrease thioesterase and/or thioesterase activity, or may be modified to alternately increase and decrease thioesterase and/or thioesterase activity depending, for example, on the cellular location(s) of the enzyme and/or on the conditions in which the modified cell or microorganism is cultured.

Embodiments of cells and microorganisms provided herein in which carbon flux is modified to increase acetyl-CoA carboxylase and/or cytosolic malonyl-CoA, may further benefit from also modifying the amount of medium-to-long chain fatty acids present in the cytosol in the esterified form as acyl-CoA (e.g., palmitoyl-CoA). In some of these embodiments, the increased generation of malonyl-CoA can lead to increased fatty acid synthesis in the presence of cytosolic fatty acid synthase (FAS). The end-product of cytosolic fatty acid synthesis in yeast cells is typically an acyl-CoA, e.g., palmitoyl-CoA, which can then be used in cellular metabolic pathways other than desired engineered target molecule production processes. This represents a loss of the carbon atoms in the acyl-CoA which could have been incorporated into target products. Additionally, high levels of cytosolic acyl-CoA end products of fatty acid synthesis (e.g., palmitoyl-CoA) can inhibit acetyl-CoA carboxylase. Therefore, production efficiency may be enhanced in some embodiments by decreasing the amount of fatty acids present in the cytosol in the esterified form as acyl-CoA.

Included in the cells, microorganisms, compositions and methods provided herein are cellular carbon flux modifications that decrease the amount of fatty acids present in the cytosol in the esterified form as acyl-CoA. In one embodiment, the amount and/or activity of thioesterase is increased in the cytosol of cells or microorganisms. The amount and/or activity of a thioesterase can be increased, for example, by increasing the number of copies of a gene encoding a thioesterase (e.g., 1, 2, 3, 4, 5, 6, 7, 8, 9, 10, 15, 20, 25 or more copies of the gene), by increasing the activity of a promoter that regulates transcription of a gene encoding a thioesterase, or by increasing the number of copies of a gene encoding a thioesterase and increasing the activity of a promoter that regulates transcription of a gene encoding a thioesterase. In certain aspects, the amount and/or activity of a thioesterase in a cell and/or a particular cellular location is increased. For example, the amount and/or activity of a thioesterase in the cytosol of a cell can be increased. In some embodiments, the pattern of expression of a thioesterase can be modified such that the enzyme is produced in a cellular location where it is not produced in an unmodified cell and/or is no longer produced in a cellular location where it is produced in an unmodified cell.

In yeast, thioesterases are generally present in the peroxisomal compartment of the cells to ensure that free coenzyme A is available for beta-oxidation. Without being bound or limited by theory, this enzyme should not normally be present in the cytoplasm because producing fatty acyl-CoA via cytosolic fatty acid synthesis is an energy intensive process, and removing the CoA from the synthesized acyl-CoA would waste the energy put into the process. In order to provide for generation of free fatty acids in the cytoplasm of modified cells or organisms, peroxisomal thioesterase with activity on long chain fatty acids can be re-targeted to the cytoplasm. In one embodiment of the cells, microorganisms and methods provided herein, host cells are modified to express engineered thioesterase polypeptides that lack targeting signals that direct the enzyme to peroxisomes (i.e, PTS), thereby introducing, or increasing the amount of, cytosolic thioesterase in the cells. In a particular embodiment, a thioesterase lacking a PTS that has activity on medium and long chain fatty acids is heterologously expressed in the cytoplasm of modified cells. This can be accomplished by modifying nucleic acids encoding a peroxisomal thioesterase to delete the portion of the nucleic acid encoding the peroxisomal targeting signal at the C-terminus of the protein, and introducing the modified heterologous nucleic acid into host cells. An example of one such modified thioesterase protein is a yeast Tes3p$^{\Delta pts}$ which excludes a peroxisomal targeting signal (PTS). As described herein, generally, a yeast peroxisomal targeting sequence is a 3-amino acid consensus sequence (PTS1). In a particular embodiment, the thioesterase enzyme can be a *Candida* yeast protein. For example, *Candida* strain ATCC 20336 contains eight genes encoding peroxisomal thioesterases (TES1-TES8), each of which contains a C-terminal 3-amino acid PTS1 consensus sequence (SRL, ARL) or slight variant thereof (PKL, PKF). Nucleotide sequences encoding the 8 thioesterases, and the amino acid acid sequences of the thioesterases, are provided herein (nucleotide SEQ ID NOS: 78, 79, 80, 81, 82, 83, 84, 85, 86 and 87 and amino acid SEQ ID NOS: 22, 23, 24, 25, 26, 27, 28, 29, 30 and 31). An example of a *Candida viswanathii* nucleotide sequence encoding a modified Tes3p lacking a peroxisomal-targeting sequence (TES3$^{\Delta pts}$), and the amino acid sequence of the modified Tes3p, are also provided herein (nucleotide SEQ ID NO: 88 and amino acid SEQ ID NO: 32). In some embodiments, the thioesterase polypeptide is from a different species than a host microorganism in which it is expressed.

Nucleic acid sequences encoding polypeptides conferring thioesterase activity can be obtained from a number of sources, including, for example, yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), and plants (e.g., *Arabidopsis, Nictotania, Cuphea*). Examples of nucleotide sequences encoding polypeptides having thioesterase activity include, without limitation, *Saccharomyces cerevisiae* PTE1 (Genbank accession no. AF124265), *Debaryomyces hansenii* (Genbank accession nos. XM_456353, XM_459767), *Aspergillus niger* (Genbank accession nos. XM_001392518, XM_011389712, XM_011395790), *Aspergillus fumigatus* (Genbank accession no. XM_742375), *Candida albicans* (Genbank accession nos. XM_705831, XM_705833), *Candida dubliniensis* (Genbank accession no. XM_002418475), *Candida orthopsilosis* (Genbank accession nos. XM_003866686, XM_003866684), *Neurospora crassa* (Genbank accession nos. XM_956915, XM_960627), *Rhodotorula toruloides* (Genbank accession no. XM_016414800), *Cryptococcus*

*neoformans* (Genbank accession no. XM_012196078, XM_012195836), *Escherichia coli* TesA (Genbank accession no. L06182) and acyl-(ACP) thioesterase type B from *Cuphea lanceolata* (Genbank accession no. CAB60830).

The promoter used for regulating transcription of a heterologous nucleic acid encoding a thioesterase can also be modified. For example, the amount of a thioesterase protein expressed in a particular cellular location may be increased by including in the heterologous nucleic acid a strong heterologous promoter and/or a promoter that provides for a different pattern of expression in the cell or microorganism. An example of one such heterologous promoter is a fatty acid inducible promoter that can provide for increased thioesterase expression, particularly when exposed to fatty acids as a carbon source. Such promoter elements include those that regulate expression of peroxisomal proteins and/or β-oxidation enzymes in microbes, e.g., a *Candida* hydratase-dehydrogenase-epimerase (HDE) gene promoter. The nucleotide sequence of a *Candida viswanathii* HDE gene promoter is provided herein as are examples of additional fatty acid-inducible promoters.

In other aspects, the amount and/or activity of a thioesterase in a cell is decreased. Methods for decreasing thioesterase activity in a cell include, but are not limited to, modifying the amount of thioesterase protein expression in the cell, for example, by replacing the wild-type promoter of an endogenous thioesterase gene in an organism with a weaker heterologous promoter, deleting or disrupting an endogenous gene, and/or replacing or modifying a gene encoding a wild-type such that the encoded modified or substituted thioesterase protein has a reduced enzyme activity.

Presence, absence or amount of thioesterase activity can be detected by any suitable method known in the art or described herein (see, e.g., Jones et al. (1999) *J. Biol. Chem.* 274(14):9216-9223 and Chemistry and Biology 9: 981-988). Nucleic acid sequences representing native and/or modified thioesterase-encoding sequences also can be detected using nucleic acid detection methods (e.g., PCR, primer extension, nucleic acid hybridization, the like and combinations thereof), or the amounts of the nucleic acids or encoded proteins can be assessed using quantitative expression based analysis (e.g., RT-PCR, western blot analysis, northern blot analysis, the like and combinations thereof), where the engineered cells or organisms exhibit increased or decreased RNA and/or polypeptide levels as compared to the host cell or organism.

Methods of Modifying Cells and Organisms

Provided herein are cells and organisms (including microorganisms) that have been modified in one or more aspects relative to the unmodified cell or organism (i.e., the cell or organism prior to the modification). For example, a cell or organism can be modified by altering one or more cellular activities and/or the sum total of a cell's or organism's activities. Thus, modifications can include, for example, alteration of cellular activities, addition of cellular activities and/or elimination of cellular activities. A cell or organism may be modified, for example, by altering the amount of one or more cellular compositions, e.g, polynucleotides and/or polypeptides. In some embodiments, an activity and/or amount of a composition can be altered by genetically modifying a host cell or microorganism which yields an engineered cell or microorganism having added, increased, reduced, decreased or removed activity or composition. Genetic modifications can be achieved in several ways, including, for example, introducing heterologous nucleic acids into host cells or organisms using molecular biological techniques known in the art and/or described herein.

Polynucleotides

The term "polynucleotide" is used herein interchangeably with the term "nucleic acid" and refers to an organic polymer composed of two or more monomers including nucleotides, nucleosides or analogs thereof, including but not limited to single stranded or double stranded, sense or antisense deoxyribonucleic acid (DNA) of any length and, where appropriate, single stranded or double stranded, sense or antisense ribonucleic acid (RNA) of any length, including siRNA. The term "nucleotide" refers to any of several compounds that consist of a ribose or deoxyribose sugar joined to a purine or a pyrimidine base (nitrogenous base) and to a phosphate group, and that are the basic structural units of nucleic acids. The term "nucleoside" refers to a compound (as guanosine or adenosine) that consists of a purine or pyrimidine base (nitrogenous base) combined with deoxyribose or ribose and is found especially in nucleic acids. The term "nucleotide analog" or "nucleoside analog" refers, respectively, to a nucleotide or nucleoside in which one or more individual atoms have been replaced with a different atom or with a different functional group. Accordingly, the term polynucleotide includes nucleic acids of any length, DNA, RNA, analogs and fragments thereof. A polynucleotide of three or more nucleotides is also called nucleotidic oligomer or oligonucleotide.

A nucleic acid (e.g., a nucleic acid reagent, target nucleic acid, target nucleotide sequence, nucleic acid sequence of interest or nucleic acid region of interest) can be from any source or composition, such as DNA, cDNA, gDNA (genomic DNA), RNA, siRNA (short inhibitory RNA), RNAi, tRNA or mRNA, for example, and can be in any form (e.g., linear, circular, supercoiled, single-stranded, double-stranded, and the like). A nucleic acid can also comprise DNA or RNA analogs (e.g., containing base analogs, sugar analogs and/or a non-native backbone and the like). It is understood that the term "nucleic acid" does not refer to or infer a specific length of the polynucleotide chain, thus polynucleotides and oligonucleotides are also included in the definition. Deoxyribonucleotides include deoxyadenosine, deoxycytidine, deoxyguanosine and deoxythymidine. For RNA, the uracil base is uridine.

The terms "endogenous polynucleotide," "endogenous nucleic acid," "native polynucleotide" and "native nucleic acid," used interchangeably herein, refer to a polynucleotide of a cell or organism that exists, or is inherent, in the genetic composition of the cell or organism prior to modification.

The terms "heterologous polynucleotide," "heterologous nucleic acid," "exogenous polynucleotide," "exogenous nucleic acid," "foreign polynucleotide" and "foreign nucleic acid," used interchangeably herein, refer to a polynucleotide as it relates to a particular reference cell or organism (e.g., a host cell or organism) and is one that is not present in the genetic composition of the reference cell or organism. A heterologous polynucleotide includes a polynucleotide that may be identical in nucleotide sequence to an endogenous polynucleotide present in a cell, but if introduced into the cell would alter the genetic composition of the cell by, for example, increasing the copy number of the polynucleotide in the cell, altering the position(s) of the polynucleotide in the cell genome, altering the expression of the polynucleotide in the cell, and the like. Thus, such a heterologous nucleic acid thereby genetically modifies the cell into which it is introduced. A heterologous polynucleotide in a host cell may exist in a nucleic acid autonomous of the host chromosome or may be inserted into a host chromosome. A heterologous polynucleotide can also be a polynucleotide with a different nucleotide sequence relative to any nucleic acid in a particular reference cell and can also be obtained from a different cell type or species of organism. A heterologous nucleic acid can also be generated by synthetic methods known in the art and/or described herein.

The term "expression" with respect to a nucleic acid sequence or protein refers to transcription of the nucleic acid and/or, as appropriate, translation of an mRNA transcript to a protein (protein synthesis). Thus, as will be clear from the context, expression of a protein results from transcription and translation of an open reading frame (ORF) sequence. The level of expression of a nucleic acid and/or protein in a cell may be determined, for example, on the basis of either the amount of RNA transcript of a nucleic acid that is present in the cell and/or the amount of the product encoded by the nucleic acid. For example, mRNA transcribed from a selected sequence can be quantitated by qRT-PCR or by Northern hybridization (see Sambrook et al., Molecular Cloning: A Laboratory Manual, Cold Spring Harbor Laboratory Press (1989)). Protein encoded by a nucleic acid can be quantitated by various methods, e.g., by ELISA, by assaying for the biological activity of the protein, or by employing assays that are independent of such activity, such as western blotting or radioimmunoassay, using antibodies that recognize and bind the protein (see Sambrook et al., 1989, supra).

A nucleic acid sometimes is a plasmid, phage, autonomously replicating sequence (ARS), centromere, artificial chromosome, yeast artificial chromosome (e.g., YAC) or other nucleic acid able to replicate or be replicated in a host cell. In certain embodiments a nucleic acid can be from a library or can be obtained from enzymatically digested, sheared or sonicated genomic DNA (e.g., fragmented) from an organism of interest. Fragments can be generated by any suitable method in the art, and the average, mean or nominal length of nucleic acid fragments can be controlled by selecting an appropriate fragment-generating procedure. In some embodiments, the fragmented DNA can be size selected to obtain nucleic acid fragments of a particular size range. Nucleic acid can be fragmented by various methods known in the art, which include without limitation, physical, chemical and enzymic processes. Examples of such processes are described in U.S. Patent Application Publication No. 20050112590 (published on May 26, 2005, entitled "Fragmentation-based methods and systems for sequence variation detection and discovery," naming Van Den Boom et al.). Certain processes can be selected to generate non-specifically cleaved fragments or specifically cleaved fragments. Examples of processes that can generate non-specifically cleaved fragment sample nucleic acid include, without limitation, contacting sample nucleic acid with apparatus that expose nucleic acid to shearing force (e.g., passing nucleic acid through a syringe needle; use of a French press); exposing sample nucleic acid to irradiation (e.g., gamma, x-ray, UV irradiation; fragment sizes can be controlled by irradiation intensity); boiling nucleic acid in water (e.g., yields about 500 base pair fragments) and exposing nucleic acid to an acid and base hydrolysis process.

Nucleic acid may be specifically cleaved by contacting the nucleic acid with one or more specific cleavage agents. The term "specific cleavage agent" as used herein refers to an agent, sometimes a chemical or an enzyme that can cleave a nucleic acid at one or more specific sites. Specific cleavage agents often will cleave specifically according to a particular nucleotide sequence at a particular site. Examples of enzyme specific cleavage agents include without limitation endonucleases (e.g., DNase (e.g., DNase I, II); RNase (e.g., RNase E, F, H, P); Cleavase™ enzyme; Taq DNA polymerase; E. coli DNA polymerase I and eukaryotic structure-specific endonucleases; murine FEN-1 endonucleases; type I, II or III restriction endonucleases such as Acc I, Afl III, Alu I, Alw44 I, Apa I, Asn I, Ava I, Ava II, BamH I, Ban II, Bcl I, Bgl I. Bgl II, Bln I, Bsm I, BssH II, BstE II, Cfo I, Cla I, Dde I, Dpn I, Dra I, EcIX I, EcoR I, EcoR I, EcoR II, EcoR V, Hae II, Hae II, Hind II, Hind III, Hpa I, Hpa II, Kpn I, Ksp I, Mlu I, MluN I, Msp I, Nci I, Nco I, Nde I, Nde II, Nhe I, Not I, Nru I, Nsi I, Pst I, Pvu I, Pvu II, Rsa I, Sac I, Sal I, Sau3A I, Sca I, ScrF I, Sfi I, Sma I, Spe I, Sph I, Ssp I, Stu I, Sty I, Swa I, Taq I, Xba I, Xho I); glycosylases (e.g., uracil-DNA glycolsylase (UDG), 3-methyladenine DNA glycosylase, 3-methyladenine DNA glycosylase II, pyrimidine hydrate-DNA glycosylase, FaPy-DNA glycosylase, thymine mismatch-DNA glycosylase, hypoxanthine-DNA glycosylase, 5-Hydroxymethyluracil DNA glycosylase (HmUDG), 5-Hydroxymethylcytosine DNA glycosylase, or 1,N6-etheno-adenine DNA glycosylase); exonucleases (e.g., exonuclease III); ribozymes, and DNAzymes. Nucleic acid may be treated with a chemical agent, or synthesized using modified nucleotides, and the modified nucleic acid may be cleaved. In non-limiting examples, nucleic acid may be treated with (i) alkylating agents such as methylnitrosourea that generate several alkylated bases, including N3-methyladenine and N3-methylguanine, which are recognized and cleaved by alkyl purine DNA-glycosylase; (ii) sodium bisulfite, which causes deamination of cytosine residues in DNA to form uracil residues that can be cleaved by uracil N-glycosylase; and (iii) a chemical agent that converts guanine to its oxidized form, 8-hydroxyguanine, which can be cleaved by formamidopyrimidine DNA N-glycosylase. Examples of chemical cleavage processes include without limitation alkylation, (e.g., alkylation of phosphorothioate-modified nucleic acid); cleavage of acid lability of P3'-N5'-phosphoroamidate-containing nucleic acid; and osmium tetroxide and piperidine treatment of nucleic acid.

As used herein, the term "complementary cleavage reactions" refers to cleavage reactions that are carried out on the same nucleic acid using different cleavage reagents or by altering the cleavage specificity of the same cleavage reagent such that alternate cleavage patterns of the same target or reference nucleic acid or protein are generated. In certain embodiments, nucleic acids of interest may be treated with one or more specific cleavage agents (e.g., 1, 2, 3, 4, 5, 6, 7, 8, 9, 10 or more specific cleavage agents) in one or more reaction vessels (e.g., nucleic acid of interest is treated with each specific cleavage agent in a separate vessel).

A nucleic acid suitable for use in the embodiments described herein sometimes is amplified by any amplification process known in the art (e.g., PCR, RT-PCR and the like). Nucleic acid amplification may be particularly beneficial when using organisms that are typically difficult to culture (e.g., slow growing, require specialize culture conditions and the like). The terms "amplify", "amplification", "amplification reaction", or "amplifying" as used herein refer to any in vitro processes for multiplying the copies of a target sequence of nucleic acid. Amplification sometimes refers to an "exponential" increase in target nucleic acid. However, "amplifying" as used herein can also refer to linear increases in the numbers of a select target sequence of nucleic acid, but is different than a one-time, single primer extension step. In some embodiments, a limited amplification reaction, also known as pre-amplification, can be performed. Pre-amplification is a method in which a limited amount of amplification occurs due to a small number of cycles, for example 10 cycles, being performed. Pre-amplification can allow some amplification, but stops amplification prior to the exponential phase, and typically produces about 500 copies of the desired nucleotide sequence(s). Use of pre-amplification may also limit inaccuracies associated with depleted reactants in standard PCR reactions.

In some embodiments, a nucleic acid reagent sometimes is stably integrated into the chromosome of a host cell or organism, or a nucleic acid reagent can be a deletion of a portion of a host chromosome, in certain embodiments (e.g., genetically modified cells or organisms, where alteration of the host genome confers the ability to selectively or preferentially maintain the desired cell or organism carrying the genetic modification). Such nucleic acid reagents (e.g., nucleic acids or genetically modified cells or organisms whose altered genome confers a selectable trait to the cell or organism) can be selected for their ability to guide production of a desired protein or nucleic acid molecule. When desired, the nucleic acid reagent can be altered such that codons encode for (i) the same amino acid, using a different tRNA than that specified in the native sequence, or (ii) a different amino acid than is normal, including unconventional or unnatural amino acids (including detectably labeled amino acids).

A nucleic acid or nucleic acid reagent can comprise certain elements often selected according to the intended use of the nucleic acid. Any of the following elements can be included in or excluded from a nucleic acid reagent. A nucleic acid reagent, for example, may include one or more or all of the following nucleotide elements: one or more promoters, one or more 5' untranslated regions (5'UTRs), one or more regions into which a target nucleotide sequence may be inserted (an "insertion element"), one or more target nucleotide sequences, one or more terminator elements, one or more 3' untranslated regions (3'UTRs), and one or more selection elements. A nucleic acid reagent can be provided with one or more of such elements and other elements may be inserted into the nucleic acid before the nucleic acid is introduced into the desired cell or organism. In some embodiments, a provided nucleic acid reagent comprises a promoter, 5'UTR, optional 3'UTR and insertion element(s) by which a target nucleotide sequence is inserted (i.e., cloned) into the nucleotide acid reagent. In certain embodiments, a provided nucleic acid reagent comprises a promoter, insertion element(s) and optional 3'UTR, and a 5' UTR/target nucleotide sequence is inserted with an optional 3'UTR. The elements can be arranged in any order suitable for expression in the chosen expression system (e.g., expression in a chosen cell or organism, or expression in a cell free system, for example), and in some embodiments a nucleic acid reagent comprises the following elements in the 5' to 3' direction: (1) promoter, 5'UTR, and insertion element(s); (2) promoter, 5'UTR, and target nucleotide sequence; (3) promoter, 5'UTR, insertion element(s) and 3'UTR; and (4) promoter, 5'UTR, target nucleotide sequence and 3'UTR.

Promoters

A promoter typically is required for cellular DNA synthesis and/or RNA synthesis. A promoter often contains a region of DNA that can facilitate the transcription of a particular gene, by providing a start site for the synthesis of RNA corresponding to a gene. Promoters generally are located near the genes they regulate, are located upstream (i.e., 5') of the START codon of the structural gene, and are on the same strand of DNA as the sense strand of the gene, in some instances. Eukaryotic promoters generally include a core promoter element that may contain a TATA box, a proximal sequence and transcription enhancer sequences positioned farther upstream (referred to, e.g., with respect to yeast, as upstream activating sequences or UAS located several hundred to thousands of kilobases upstream from a transcriptional start site (TSS)). The types and combination of these elements can influence promoter strength (see, e.g., Hussain et al. (2016) ACS *Synth. Biol.* 5:213-223). As used herein, "promoter," "promoter sequence" and "promoter region" are used interchangeably to refer to nucleotide sequences that can regulate gene transcription. Such sequences can include, but are not limited to, core promoter (e.g., extending upstream from the transcription START site (TSS)) elements (e.g., TATA box, RNA polymerase binding site, CCAAT box), proximal cis-acting sequences that bind proteins and can facilitate binding of RNA polymerase to DNA, and distant cis-regulatory sequences (e.g, enhancers and silencers) that can bind transcription factors and influence (e.g., activate, increase, elevate, decrease, reduce) transcription.

In some embodiments, a promoter sequence can be isolated from a nucleic acid or cell or organism and combined in functional connection or operable linkage with a polynucleotide sequence to allow altered and/or regulated expression. A non-native promoter (e.g., promoter not normally associated with a given nucleic acid sequence) used for expression of a nucleic acid often is referred to as a heterologous promoter. In certain embodiments, a heterologous promoter and/or a 5'UTR can be combined in functional connection with a polynucleotide that encodes a polypeptide having a desired activity as described herein. The terms "operably linked" and "in functional connection with" as used herein with respect to promoters, refer to a relationship between a nucleic acid coding sequence and a promoter element. The promoter is operably linked or in functional connection with the coding sequence when expression from the coding sequence via transcription is regulated, or controlled by, the promoter element. The terms "operably linked" and "in functional connection with" are utilized interchangeably herein with respect to promoter elements.

A promoter often interacts with a RNA polymerase. A polymerase is an enzyme that catalyzes synthesis of nucleic acids using a preexisting nucleic acid reagent. When the template is a DNA template, an RNA molecule is transcribed before protein is synthesized. Enzymes having polymerase activity suitable for use in the present methods include any polymerase that is active in the chosen system with the chosen template to synthesize protein. In some embodiments, a promoter (e.g., a heterologous promoter), can be operably linked to a nucleotide sequence or an open reading frame (ORF). Transcription from the promoter element can catalyze the synthesis of an RNA corresponding to the nucleotide sequence or ORF sequence operably linked to the promoter, which in turn leads to synthesis of a desired peptide, polypeptide or protein.

There are generally several types of promoters, e.g., constitutive, repressible and inducible. Constitutive promoters can be considered as unregulated (i.e., regulated essentially only by RNA polymerase levels) and provide for consistent expression of a gene that is under the transcriptional control of the promoter. Repressible and inducible promoters are regulatable by various cellular conditions. A repressible promoter is one that can be silenced, or "turned off," by the binding of a repressor molecule to a particular nucleotide sequence which serves to inhibit the functional interaction of RNA polymerase with the promoter and inhibits transcription. This is referred to as negative control or regulation and is in contrast to positive control of transcription which can occur via activator molecules binding to DNA and increasing the rate of transcription. An inducible promoter is one in which transcription can be induced in the presence of an effector molecule that, for example, binds to a regulatory transcription factor and results in increased rates of transcription. As used herein, a "non-inducible" promoter is a promoter that does not exhibit increased activity, in terms of transcription activation of an operably linked nucleic acid, in response to the presence of an effector or inducing agent. A non-inducible promoter can be one that is not induced by one agent but is induced by another. For example, the transcription-regulating activity of a non-fatty acid-inducible promoter is not detectably increased in the presence of a fatty acid, although there may be other agents that do induce the promoter and increase transcription of a nucleic acid operably linked to the promoter.

Promoters sometimes exhibit responsiveness to regulatory control. Promoters also sometimes can be regulated by a selective agent. That is, transcription from promoters sometimes can be turned on, turned off, up-regulated or down-regulated, in response to a change in environmental, nutritional or internal conditions or signals (e.g., heat inducible promoters, light regulated promoters, feedback regulated promoters, hormone influenced promoters, tissue specific promoters, oxygen and pH influenced promoters, promoters that are responsive to selective agents (e.g., kanamycin) and promoters responsive to certain carbon sources (e.g., fatty acids) and the like, for example). Promoters influenced by environmental, nutritional or internal signals frequently are influenced by a signal (direct or indirect) that binds at or near the promoter and increases or decreases expression of the target sequence under certain conditions.

The strength of a promoter sequence can be measured as the amount of transcription of a gene product initiated at the promoter relative to a reference or control. For example, a reference or control can be the amount of transcription of the same gene product (e.g., a reporter gene product) initiated from a standard or reference promoter under the same conditions. In assessing the strength of an inducible promoter, the amount of transcription of a gene product that occurs from the promoter in the absence (non-inducing conditions) and presence (inducing conditions) of an inducing factor, or environment or condition, can be compared to determine the degree of inducibility. The difference in those transcription amounts can also be compared to the difference in transcription amounts under the same non-inducing and inducing conditions of a reference or control promoter to determine relative strength and inducibility. Methods for evaluating promoter strength using quantitative techniques for measuring gene product expression include, for example, RT-qPCR, northern blot techniques, and reporter gene product expression assays (see, e.g., Teste et al. (2009) BMC Molecular Biology 10:99; Wang et al. (2016) Yeast 33:99-106; Peng et al. (2015) Microb. Cell Fact. 14:91). For example, transcription (e.g., measured in ways known in the art) can sometimes be increased by at least about the following percentages when an inducible promoter controlling transcription of a nucleic acid is subjected to inducing conditions as compared to transcription under non-inducing conditions: by at least about 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 100% or more. In some instances, transcription can sometimes be increased by at least about the following fold when an inducible promoter controlling transcription of a nucleic acid is subjected to inducing conditions as compared to transcription under non-inducing conditions: at least about 1.5-fold, 2-fold, 2.5-fold, 3-fold, 3.5-fold, 4-fold, 4.5-fold, 5-fold, 5.5-fold, 6-fold, 6.5-fold, 7-fold, 7.5-fold, 8-fold, 8.5-fold, 9-fold, 9.5-fold, 10-fold, 11-fold, 12-fold, 13-fold, 14-fold, 15-fold, 20-fold or more.

In some instances, the use of a stronger heterologous inducible promoter to control transcription can increase the amount of induced transcription of a product-encoding nucleic acid by at least about the following percentages over the amount of induced transcription of the same nucleic acid controlled by a weaker inducible promoter: by at least about 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 100% or more. In some instances, the use of a stronger heterologous inducible promoter to control transcription can increase the amount of induced transcription of a product-encoding nucleic acid by at least about the following fold over the amount of induced transcription of the same nucleic acid controlled by a weaker inducible promoter: by at least about 1.5-fold, 2-fold, 2.5-fold, 3-fold, 3.5-fold, 4-fold, 4.5-fold, 5-fold, 5.5-fold, 6-fold, 6.5-fold, 7-fold, 7.5-fold, 8-fold, 8.5-fold, 9-fold, 9.5-fold, 10-fold, 11-fold, 12-fold, 13-fold, 14-fold, 15-fold, 20-fold or more.

In some embodiments, regulation of a promoter can be used to alter (e.g., increase, add, decrease or substantially eliminate) the activity of a peptide, polypeptide or protein (e.g., enzyme activity). For example, a cell or microorganism can be engineered by genetic modification to express a nucleic acid reagent that can add a novel activity (e.g., an activity not normally found in the host cell or organism) or increase the expression of an existing activity by increasing transcription from a homologous or heterologous promoter operably linked to a nucleotide sequence of interest (e.g., heterologous nucleotide sequence of interest), in certain embodiments. In some embodiments, a cell or microorganism can be engineered by genetic modification to express a nucleic acid reagent that can decrease expression of an activity by decreasing or substantially eliminating transcription from a homologous or heterologous promoter operably linked to a nucleotide sequence of interest, in certain embodiments. In some embodiments, an inducible heterologous promoter can be used to regulate transcription of a protein-encoding nucleic acid that is a stronger, or more strongly inducible, promoter than an endogenous inducible promoter that regulates expression of the protein-encoding nucleic acid in its endogenous state.

In some embodiments the activity can be altered using recombinant DNA and genetic techniques known to the artisan. Methods for engineering cells and microorganisms are further described herein. Also provided herein are nonlimiting examples of regulated promoters, e.g., promoters that are up-regulated by oxygen, promoters that are down-regulated by oxygen, promoters that are repressed in the presence of certain carbon sources (e.g, glucose), promoters that are de-repressed under certain carbon source conditions (e.g., limited or depleted glucose and/or non-fermentable carbon sources), promoters that are induced in the presence of certain carbon sources (e.g., fatty acids), transcriptional repressors and their associated genes, DNA binding motifs as determined using the MEME sequence analysis software. Potential regulator binding motifs can be identified using the program MEME to search intergenic regions bound by regulators for overrepresented sequences. For each regulator, the sequences of intergenic regions bound with p-values less than 0.001 are extracted to use as input for motif discovery. The MEME software can be run, for example, using the following settings: a motif width ranging from 6 to 18 bases, the "zoops" distribution model, a $6^{th}$ order Markov background model and a discovery limit of 20 motifs. The discovered sequence motifs can be scored for significance by two criteria: an E-value calculated by MEME and a specificity score. The motif with the best score using each metric is shown for each regulator.

Carbon Source-Dependent Gene Regulatory Elements

Many cells and organisms, including, for example, many yeast species, preferentially use glucose over other carbon sources. Often, cell and organism growth is maximal in the presence of glucose. However, some cells and organisms are able to use alternative carbon sources for the production of metabolic energy and cellular biomass. In doing so, cellular metabolism can undergo substantial changes as certain pathways (such as, for example, oxidative metabolism, the TCA cycle, glyoxylate cycle and gluconeogenesis) required for utilizing non-glucose carbon sources are activated. Genes encoding such pathway-specific components can be subject to carbon source regulation of transcription. When glucose is present as a carbon source, some components (e.g. enzymes) of these other pathways may not be expressed, or are less expressed, because the pathways are not essential, or are used to a lesser extent, in the presence of glucose. This is referred to as glucose repression. Thus, in contrast to unregulated constitutive promoters, transcription regulatory elements for genes such as these are repressed, derepressible and/or inducible by varying carbon sources. When glucose is depleted, genes that were subject to glucose repression are then transcribed in a process referred to as glucose derepression. For some of these genes, this increase in transcription due to derepression represents the extent to which the genes will be expressed because they are not subject to induction and further increased transcription. For others of these genes, transcription may be increased (e.g., several-fold) over the derepressed level upon induction by, for example, certain carbon sources. Examples of such carbon sources include fatty acids (e.g, oleic acid) and n-alkanes. Some genes encoding peroxisomal proteins (including enzymes involved in fatty acid catabolism) are subject to glucose repression/derepression. Cis-acting regulatory elements have been identified for some of these genes. For example, sequences located upstream of the TATA boxes in the *Saccharomyces cerevisiae* FOX1 gene encoding an acyl-CoA oxidase and FOX3 gene encoding 3-oxoacyl-CoA thiolase have been reported as glucose response elements (see, e.g., Wang et al. (1992) *Nucleic Acids Res.* 20:3495; Wang et al. (1994) *J. Biol. Chem.* 269:24480; and Einerhand et al. (1991) *Eur. J. Biochem.* 200:113).

As described herein, engineered alteration of carbon flux in cells and organisms can involve directing internalized carbon sources toward particular cellular processing pathways and/or away from particular pathways. Some host cell modifications made in engineered bioproduction systems described herein can depend in part on the carbon source or sources used and the target molecule being produced. For example, in some embodiments provided herein, cells or organisms are modified to enhance carbon flux through oxidative metabolism pathways (e.g., β-oxidation and/or ω-oxidation) and/or fatty acid synthesis for production of organic acid, polyketide, terpene and/or other target molecules. In particular embodiments, the modified cells or organisms are provided with non-fermentable carbon sources (e.g., fatty acids, alkanes) and/or limited amounts of, or no, glucose for production of target molecule production. In these and other embodiments described herein, genetic modifications may be made to the cells or organisms to, for example, modify the amount and/or activity of one or more enzymes (e.g., acetyl-CoA carboxylase, ATP citrate lyase, carnitine acetyltransferase, acyl-CoA thioesterase, acetyl-CoA hydrolase, acetyl-CoA synthetase) in carbon-processing pathways. As also described herein, in some of these genetic modifications, it may be beneficial to use heterologous transcription-regulating nucleic acid elements that are differentially responsive to certain carbon sources for controlling expression of the enzyme(s). For example, promoters and other regulatory nucleic acid elements that are repressed when glucose is present, derepressed in glucose-limiting, or depleted, conditions and/or induced in the presence of alternative carbon sources can provide for optimized and regulatable production of target molecules, such as in embodiments involving use of non-glucose carbon sources. This is particularly useful in instances where target molecules may be toxic to cells or organisms in high levels. In this example, modified cells could initially be cultured in the presence of glucose, if desired to build up cell mass during a growth phase, and then switched to an alternative carbon source for target molecule production through engineered pathways during which time expression of modified enzymes would be derepressed and/or induced.

In some embodiments of the engineered cells and organisms provided herein, carbon flux alterations may include diversion of carbon atoms (e.g., acetyl groups) away from particular cellular pathways (e.g. the TCA cycle) to minimize carbon atom loss to those pathways at the expense of target molecule-producing pathways. In these instances, it may be beneficial to modify and/or replace promoters and other transcription regulatory elements that control expression of components (e.g., mitochondrial proteins such as carnitine acetyltransferase and carnitine transporters) of pathways not involved in target molecule production such that the components are not expressed, or are expressed at reduced levels, under glucose-limiting conditions and/or in the presence of alternative carbon sources. Heterologous transcription-regulatory nucleic acid elements suitable in achieving such control include, but are not limited to, weak, constitutive promoters and promoters that are repressed when non-glucose (or non-fermentable) carbon sources are available, derepressed when glucose is present and/or induced in the presence of glucose. Examples of such transcriptional control elements include, but are not limited to, promoter sequences regulating transcription of genes encoding phosphoglycerate kinase (PGK), glyceraldehyde-3-phosphate dehydrogenase (GPD), translation elongation factor (TEF) and glucose-6-phosphate isomerase (G6PI; also referred to as phosphoglucose isomerase or PGI). Nucleotide sequences for promoters of the PGK (SEQ ID NO: 114), GPD (SEQ ID NO: 119), TEF (SEQ ID NO: 120)

and G6PI (SEQ ID NO: 118) genes of *Candida* strain ATCC 20336 are provided herein. Additional examples of sources of PGK, GPD, TEF and G6P1 gene sequences include, but are not limited to: *Saccharomyces cerevisiae* PG/1 (Genbank accession no. X13977), *Aspergillus oryzae* PGK (Genbank accession no. E04898), *Yarrowia lipolytica* PGK (Genbank accession no. M91598), *Candida albicans* PGK (Genbank accession no. U25180), *Candida* ma/toss C-PGK1 (Genbank accession no. D12474), *Saccharomyces cerevisiae* GPD (Genbank accession no. M13807), *Cyberlindnera jadinii* GAP (Genbank accession no. FJ664342), *Yarrowia lipolytica* TEF1 (Genbank accession no. AF054508), *Debaryomyces hansenii* TEF1 (Genbank accession no. AM600962).

Genes that are transcriptionally regulated by carbon source availability to cells (see, e.g., Turcotte et al. (2010) *FEMS Yeast Res.* 10:2-13; Weinhandl et al. (2014) *Microbial Cell Factories* 13(5):1-17) are possible sources of carbon source-dependent heterologous promoters for use in modification of cells and organisms as described herein. For example, genes encoding glycerol kinase and glycerol-3-phosphate dehydrogenase, such as the GUT1 and GUT2 genes of yeast, respectively, can be repressed in the presence of fermentable carbon sources such as glucose and expressed in the presence of non-fermentable carbon sources, e.g., glycerol or ethanol. When glucose is present, repression of the *Saccharomyces cerevisiae* GUT1 and GUT2 genes occurs in cells and is mediated by the negative regulator Opi1. The promoter region of the *Saccharomyces cerevisiae* GUT1 gene contains two upstream transcription activation sequences, $UAS_{ADR1}$ and $UAS_{INO}$, that can be binding sites for Adr1p (a zinc finger transcription factor) and Ino2p/Ino4p (basic helix-loop-helix factors), respectively, which are responsible for about 90% of the GUT1 gene expression in the presence of glycerol (see, e.g., Grauslund et al. (1999) *Nucleic Acids Res.* 27(22):4391-4398). Similarly, the promoter region of the *S. cerevisiae* GUT2 gene contains a $UAS_{HAP}$ upstream sequence that can be a binding site for the Hap2/3/4/5 protein complex which activates transcription of several genes with mitochondrial functions (see, e.g., Grauslund and Ronnow (2000) *Can. J. Microbiol.* 46:1096-1100). The $UAS_{HAP}$ element is required for full expression of the GUT2 gene in the presence of glycerol or ethanol.

Additional examples of carbon source-dependent promoters include regulatory nucleic acid sequences controlling the transcription of genes encoding some polypeptides involved in fatty acid metabolism, peroxisomal transport/biogenesis and/or the glyoxylate cycle. Some of these genes undergo significant induction of transcription in the presence of fatty acids (e.g., oleic acid) and/or n-alkanes. This phenomenon is referred to as fatty acid or oleic acid (or oleate) induction or alkane induction. In yeast, some of the genes subject to fatty acid induction are transcriptionally controlled by promoter regions containing an oleate response element (ORE).

In *Saccharomyces cerevisiae*, for example, the ORE of fatty acid-inducible gene promoters binds the positive transcription factor of zinc cluster proteins, Pip2p-Oaf1p. The promoter region of such genes typically contains a palindrome sequence of two CGG triplets with a sequence of 15-18 nucleotides between them that includes at least one half site containing a TNA triplet (where "N" represents any nucleotide) and thus has the sequence 5'-CGGNNNTNA ($N_{9-12}$)CCG-3' (see, e.g., Gurvitz and Rottensteiner (2006) *Biochim. Biophys. Acta* 1763:1392-1402). Variants of this sequence in fatty acid-inducible *S. cerevisiae* gene promoters have been identified in connection with the ANT1 and PEX25 genes leading to the following sequence as being considered the minimal ORE: $CGGNNNTN^{A/}_{R}(N_{8-12})CCG$ (see, e.g., Rottensteiner et al. (2003) *Eur. J. Biochem.* 270:2013-2022). Some of the promoter regions of fatty acid-inducible *S. cerevisiae* genes also include a type 1 upstream activation sequence (UAS1) having a consensus sequence of $CYCCR(A/T/G)N_{4-36}(T/A/C)YGGRG$ that binds the Adr1 transcription factor and directly regulates some *S. cerevisiae* genes including SPS19, POX1, CTA1, PEX11, PIP2 which encode peroxisomal proteins (e.g., peroxisomal 2,4-dienoyl-CoA reductase, or SPS19p, and Pex11p) and/or proteins involved in β-oxidation (e.g., acyl-CoA oxidase or Pox1p) or involved in the regulation of genes associated with fatty acid metabolism (see, e.g., Gurvitz et al. (2000) *Mol. Cell. Biol. Res. Commun.* 4:81-89; Gurvitz et al. (2001) *J. Biol. Chem.* 276:31825-31830; Rottensteiner et al. (2003) *J. Biol. Chem.* 278:27605-276110). Additional *S. cerevisiae* gene promoter regions containing an ORE include those controlling transcription of MDH3 (peroxisomal malate dehydrogenase), YCAT (peroxisomal and mitochondrial carnitine acetyltransferase), CRC1 (mitochondrial carnitine transporter) and TES1 (peroxisomal thioesterase) (see, e.g., Karpichev and Small (1998) *Mol. Cell. Bio.* 18:6560-6570).

There are numerous DNA-binding factors and regulatory proteins involved in transcriptional regulation associated with carbon source utilization. For example, in yeast such as *S. cerevisiae*, glucose repression is mediated by repressors such as, for example, members of the Mig family of $C_2H_2$-zinc-finger DNA-binding proteins, and some zinc cluster proteins, e.g., Oaf3. The promoter regions of genes subject to glucose repression typically contain a GC-rich recognition site (e.g., SYGGGG) to which a repressor, e.g., Mig1, binds in the presence of high levels of glucose (see, e.g., Gancedo (1998) *Microbiol. Mol. Biol. Rev.* 62(2):334-361). The repressor recruits a repressor complex, e.g., Ssn6-Tup1, resulting in conformational changes in the chromatin structure that prevent transcription initiation factors (e.g., the Sip4 and Adr1 activators of genes encoding, for example, gluconeogenic and glycerol or ethanol utilization proteins) from binding to sites in the DNA. Derepression occurring when glucose is depleted can result in activation of a protein kinase, Snf1, which participates in phosphorylation and release of the repressor complex thereby allowing for the activator to bind DNA in the promoter region. A shift from glucose-repressing to derepressing conditions typically results in an increased binding of Oaf1-Pip2 to oleate-response elements in promoters of fatty acid-inducible genes; however, in the presence of inducer (e.g., oleic acid), there may be only a marginal increase in this binding. This is because under derepressed conditions, Oaf1-Pip2 may be constitutively bound to target gene promoters. Activation of Oaf1-Pip2 involves binding of oleate to Oaf1 which is hyper-phosphorylated in the presence of oleate. In the activation of some fatty acid-inducible genes, Adr1 may also be involved. For example, promoter regions of genes encoding peroxisomal proteins often include a UAS1 that binds Adr1. DNA motifs for regulator protein (e.g., Adr1p, Hap2, Mig1) binding in carbon source-dependent promoters have been identified (see e.g., Weinhandl et al. (2014) *Microbial Cell Factories* 13(5):1-17) as have entire carbon source-dependent promoter nucleic acid sequences.

In other fungi, there can be different DNA-binding factors and regulatory proteins involved in transcriptional regulation associated with carbon source utilization. For example, in the filamentous fungus *Aspergillus nidulans*, glucose repression is mediated by the CreA repressor. In order to grow on fatty acids as a sole carbon source, this fungus typically requires two $Zn_2Cys_6$ proteins, FarAp and FarBp. These proteins are transcription factors that bind to a CCTCGG motif contained in the promoter region of genes encoding proteins involved in β-oxidation, peroxisomal functions and the glyoxylate cycle in this fungus. Specifically, FarAp is required for oxidation of short- and long-chain fatty acids and FarBp is required for oxidation of short-chain fatty acids. A homolog of FarA/FarB in *Candida albicans*, referred to as Ctf1p, is typically required for growth of *C. albicans* on fatty acids and regulates expression of some of the genes encoding proteins involved in β-oxidation.

Fatty acid- and/or alkane-inducible promoters from other organisms include, but are not limited to, those regulating transcription of the following genes: *Yarrowia lipolytica* POX2 (acyl-CoA oxidase; Genbank accession no. AJ001300), *Yarrowia lipolytica* POT1 (3-oxo-acyl-CoA thiolase; Genbank accession no. X69988), *Yarrowia lipolytica* ICL1 (isocitrate lyase; Genbank accession no. CQ771439) and *Candida tropicalis* HDE (hydratase-dehydrogenase-epimerase; Genbank accession no. X57854), *Candida tropicalis* POX4 (acyl-CoA oxidase; Genbank accession no. AB031271), *Candida tropicalis* POX18 (peroxisomal 18-kDa protein; Genbank accession no. X53633), *Candida tropicalis* SPS19 (2,4-dienoyl-CoA reductase; Genbank accession no. XM_002545237), *Candida albicans* PEX11 (peroxisomal protein; Genbank accession no. XM_707009), *Candida tropicalis* P450alk (alkane-inducible cytochrome P450; Genbank accession no. M24894), and *Candida tropicalis* CATL (catalase; Genbank accession no. AB181391) (see, e.g., Hussain et al. (2016) *ACS Synth. Biol.* 5:213-223 and Sloots et al. (1991) *Gene* 105:129-134). Sequences of promoter elements of fatty acid-inducible genes (e.g., HDE, POX4, PEX11) from *Candida* strain ATCC 20336 are also provided herein (SEQ ID NOS: 113, 117 and 121).

The promoter region controlling transcription of the *Candida tropicalis* peroxisomal HDE gene includes a sequence similar to, but with deviations from, the *S. cerevisiae* ORE consensus sequence, and is as follows: $CGGNNNTTAN_{12}CAG$. This sequence, located in a region between nucleotides-393 and -341 (relative to the nucleotide of the translation START codon), contains a 3' triplet of CAG in contrast to the CCG 3' triplet of the *S. cerevisiae* ORE consensus sequence. Specific nucleotides of the *C. tropicalis* HDE gene promoter ORE are CGGTTAT-TACGCCTGGGGGGGCAG. Similar sequences occur in the upstream promoter regions of *C. tropicalis* genes POX4, POX18, P450alk and CATL (see Sloots et al. (1991) *Gene* 105:129-134). The promoter regions for these genes (and the HDE gene) can also contain sequences similar to a 7-nucleotide consensus sequence ($ATTTCC_TC_T$) for regulation of the *S. cerevisiae* SUC2 gene by glucose. This glucose-responsive region of the *C. tropicalis* HDE gene is located between nucleotides-526 and -393.

Alkane-assimilating organisms, such as, for example, *Candida tropicalis, Candida maltosa, Candida albicans, Candida bombicola, Candida parapsilosis, Yarrowia lipolytica, Pichia stipitis* and *Debaryomyces hansenii*, can utilize alkanes by first converting them to fatty alcohols through oxidation catalyzed by cytochrome P450. The fatty alcohols are then oxidized to fatty aldehydes which are in turn oxidized to fatty acids. Promoters for some of the genes in alkane-assimilating yeast have been shown to contain alkane-responsive elements. For example, an upstream activating sequence referred to as ARE1 and having a sequence $CTTGTGN_xCATGTG$ (where N represents any nucleotide and x refers to the number of nucleotides) has been identified as an alkane-responsive element present in the promoter of the *Yarrowia lipolytica* ALK1 gene (cytochrome P450; Genbank accession no. AB010388) (see, e.g., Sumita et al (2002) *Biochem. Biophys. Res. Commun.* 294:1071-1078). Similar ARE1-like sequences (and/or conserved repeating motif: TGTG, or the CACA complement) occur in promoters of other genes encoding enzymes involved in alkane degradation, including, for example, cytochrome P450 genes of *Candida tropicalis*, (see, e.g., Seghezzi et al. (1992) *DNA Cell Biol.* 11:767-780), *Candida maltosa* (Genbank accession no. X55881), *Debaryomces hansenii* (Genbank accession no. AF103948) and also thiolase genes such as the acetoacetyl-CoA thiolase encoded by the *Y. lipolytica* PAT1 gene (Genbank accession no. AB1020846) and the peroxisomal 3-ketoacyl-CoA thiolase encoded by the *C. tropicalis* CT-T3A gene (Genbank accession no. AB025647).

Possible additional candidate fatty acid- and/or alkane-inducible promoter sequences may be identified by searching genome databases for ORE consensus sequences located within about 500-1000 bp upstream of the START codon of an ORF and operably linking identified sequences with a reporter protein-encoding nucleic acid sequence for introduction into a host cell and analysis of reporter protein expression in the presence of varying carbon sources (such as fermentable and non-fermentable carbon sources and, in particular, fatty acids). Induced reporter protein expression in the presence of fatty acids and/or alkanes is indicative of a regulable, fatty acid- and/or alkane-inducible promoter sequence being linked to the reporter protein-encoding nucleic acid. Computer-assisted bioinformatics search programs are also available for use in identifying candidate transcription regulatory elements for genes (see, e.g., Worldwide Web uniform Resource Locator (URL) yeastract.com; Worldwide Web uniform Resource Locator (URL) pepper.molgenrug.nl/; Worldwide Web uniform Resource Locator (URL) rulai.cshl.edu/SCPD/; Worldwide Web uniform Resource Locator (URL) bimas.cit.nih.gov/molbio/proscan/; Worldwide Web uniform Resource Locator (URL) bioit.dmbr.ugent.be/contrav2/index.php).

Untranslated Regions (UTR)

Nucleic acid reagents may also contain one or more 5' UTRs, and one or more 3'UTRs. Untranslated regions of a gene are sequences that are transcribed but are not translated into protein. A 5' UTR generally extends from the transcription start initiation site up to the first nucleotide of the translation START codon. A 3' UTR generally extends from the translation STOP codon to the polyA tail. Untranslated sequences can play important roles in post-transcriptional gene expression, including, for example, transport of a transcript out of the nucleus, translation efficiency, subcellular localization and mRNA stability.

A 5' UTR used in a nucleic acid reagent in genetically modifying cells may include one or more elements that are associated with it in an endogenous state, e.g., in a cell from which it originates, and sometimes includes one or more exogenous elements. A 5' UTR can originate from any suitable nucleic acid, such as genomic DNA, plasmid DNA, RNA or mRNA, for example, from any suitable organism (e.g., virus, bacterium, yeast, fungi, plant, insect or mammal). Appropriate elements for the 5' UTR can be selected based upon the chosen expression system (e.g., expression in a chosen organism, or expression in a cell free system, for example). A 5' UTR sometimes contains one or more of the following elements: enhancer sequences (e.g., translational), translation regulation site, translation initiation site, translation factor binding site, accessory protein binding site, feedback regulation agent binding sites, ribosome binding site, replicon, internal ribosome entry site (IRES), silencer element and the like. In some embodiments, a promoter element may be isolated such that all 5' UTR elements necessary for proper conditional regulation are contained in the promoter element fragment, or within a functional subsequence of a promoter element fragment.

A 5' UTR in the nucleic acid reagent can include a translational enhancer nucleotide sequence. A translational enhancer nucleotide sequence often is located between the promoter and the target nucleotide sequence in a nucleic acid reagent. A translational enhancer sequence often binds to a ribosome, sometimes is an 18S rRNA-binding ribonucleotide sequence (i.e., a 40S ribosome binding sequence) and sometimes is an internal ribosome entry sequence (IRES). An IRES generally forms an RNA scaffold with precisely placed RNA tertiary structures that contact a 40S ribosomal subunit via a number of specific intermolecular interactions. Examples of ribosomal enhancer sequences are known and can be identified by the artisan (e.g., Mignone et al. (2005) *Nucleic Acids Research* 33: D141-D146; Paulous et al. (2003) *Nucleic Acids Research* 31:722-733; Akbergenov et al. (2004) *Nucleic Acids Research* 32:239-247; Mignone et al. (2002) *Genome Biology* 3(3): reviews0004.1-0001.10; Gallie (2002) *Nucleic Acids Research* 30:3401-3411; Shaloiko et al., Worldwide Web uniform Resource Locator (URL) interscience.wiley.com, DOI: 10.1002/bit.20267; and Gallie et al. (1987) *Nucleic Acids Research* 15:3257-3273).

A translational enhancer sequence sometimes is a eukaryotic sequence, such as a Kozak consensus sequence or other sequence (e.g., hydroid polyp sequence, GenBank accession no. U07128). A translational enhancer sequence sometimes is a prokaryotic sequence, such as a Shine-Dalgarno consensus sequence. In certain embodiments, the translational enhancer sequence is a viral nucleotide sequence. A translational enhancer sequence sometimes is from a 5' UTR of a plant virus, such as Tobacco Mosaic Virus (TMV), Alfalfa Mosaic Virus (AMV); Tobacco Etch Virus (ETV); Potato Virus Y (PVY); Turnip Mosaic (poty) Virus and Pea Seed Borne Mosaic Virus, for example. In certain embodiments, an omega sequence about 67 bases in length from TMV is included in the nucleic acid reagent as a translational enhancer sequence (e.g., devoid of guanosine nucleotides and includes a 25 nucleotide long poly (CAA) central region).

A 3' UTR used in a nucleic acid reagent in genetically modifying cells may include one or more elements that are associated with it in an endogenous state, e.g., in a cell from which it originates, and sometimes includes one or more exogenous elements. A 3' UTR may originate from any suitable nucleic acid, such as genomic DNA, plasmid DNA, RNA or mRNA, for example, from any suitable organism (e.g., a virus, bacterium, yeast, fungi, plant, insect or mammal). Appropriate elements for the 3' UTR can be selected based upon the chosen expression system (e.g., expression in a chosen organism, for example). A 3' UTR sometimes comprises one or more of the following elements: translation regulation site, translation termination site, translation initiation site, translation factor binding site, ribosome binding site, replicon, enhancer element, silencer element and polyadenosine tail. A 3' UTR often includes a polyadenosine tail and sometimes does not, and if a polyadenosine tail is present, one or more adenosine moieties may be added or deleted from it (e.g., about 5, about 10, about 15, about 20, about 25, about 30, about 35, about 40, about 45 or about 50 adenosine moieties may be added or subtracted).

In some embodiments, modification of a 5' UTR and/or a 3' UTR can be used to alter (e.g., increase, add, decrease or substantially eliminate) gene expression activity. This can in turn alter the activity of a peptide, polypeptide or protein (e.g., enzyme activity for example), by a change in transcription of the nucleotide sequence(s) of interest from an operably linked promoter element comprising the modified 5' or 3' UTR. For example, a microorganism can be engineered by genetic modification to express a nucleic acid reagent comprising a modified 5' or 3' UTR that can add a novel activity (e.g., an activity not normally found in the host organism) or increase the expression of an existing activity by increasing transcription from a homologous or heterologous promoter operably linked to a nucleotide sequence of interest (e.g., homologous or heterologous nucleotide sequence of interest), in certain embodiments. In some embodiments, a microorganism can be engineered by genetic modification to express a nucleic acid reagent comprising a modified 5' or 3' UTR that can decrease the expression of an activity by decreasing or substantially eliminating transcription from a homologous or heterologous promoter operably linked to a nucleotide sequence of interest, in certain embodiments.

Nucleic Acid or Protein Similarity

In addition to the nucleotide and amino acid sequences provided herein, a polynucleotide or polypeptide sequence may also be one that is substantially similar to those provided herein, including, but not limited to, promoter sequences, regulatory sequences, coding polynucleotides, amino acid signal sequences and amino acid protein sequences provided herein. Similarity between two nucleic acids or polypeptides refers to the relatedness between nucleotide sequences or amino acid sequences. Similarity can be based on the degree of identity and/or homology of sequences and the residues contained therein. Methods of assessing the degree of similarity between nucleic acids or proteins are known to those of skill in the art. For example, in one method of assessing sequence similarity, two nucleotide or amino acid sequences are aligned in a manner that yields a maximal level of identity between the sequences. Identity refers to the extent to which the sequences are invariant. Alignment of amino acid sequences, and, to some extent, nucleotide sequences, also can take into account conservative differences and/or frequent substitutions in amino acids (or nucleotides). Conservative differences are those that conserve the physico-chemical properties of the residues involved. Alignments can be global (alignment of the compared sequences over the entire length of the sequences and including all residues) or local (alignment of a portion of the compared sequences e.g., a portion or portions that includes only the most similar region or regions). Homology, with reference to polynucleotide or polypeptide sequences, refers to nucleotide or amino acid sequence similarity that takes into account identical residues and residues that can substitute for one another.

Percent identity and/or homology may be determined, for example, by comparing sequence information using any of a number of computer algorithms known in the art. In one example, calculations of sequence identity can be performed as follows. Sequences are aligned for optimal comparison purposes (e.g., gaps can be introduced in one or both of a first and a second amino acid or nucleic acid sequence for optimal alignment, and non-homologous sequences can be disregarded for comparison purposes). The length of a reference sequence aligned for comparison purposes is sometimes 30% or more, 40% or more, 50% or more, often 60% or more, and more often 70% or more, 80% or more, 90% or more, or 100% of the length of the reference sequence. The nucleotides or amino acids at corresponding nucleotide or polypeptide positions, respectively, are then compared among the two sequences. When a position in the first sequence is occupied by the same nucleotide or amino acid as the corresponding position in the second sequence, the nucleotides or amino acids are deemed to be identical at that position. The percent identity between the two sequences is a function of the number of identical positions shared by the sequences, taking into account the number of gaps, and the length of each gap, introduced for optimal alignment of the two sequences. Examples of sequence alignment and analysis software that can be used to calculate sequence identity include BLAST (Worldwide Web uniform Resource Locator (URL) blast.ncbi.nlm.nih.gov/Blast.cgi), MUSCLE (Worldwide Web uniform Resource Locator (URL) ebi.ac.uk/Tools/msa/muscle/ and Worldwide Web uniform Resource Locator (URL) drive5.com/muscle/) and MAFFT (Worldwide Web uniform Resource Locator (URL) mafft.cbrc.jp/alignment/server/ and Worldwide Web uniform Resource Locator (URL) ebi.ac.uk/Tools/msa/mafft/) for comparing nucleotide sequences and SIM (Worldwide Web uniform Resource Locator (URL) web.expasy.org/sim/) and BLAST for comparison of amino acid sequences. Nucleic acid sequence identity can also be determined by hybridization assays conducted under stringent conditions. As used herein, the term "stringent conditions" refers to conditions for hybridization and washing. Stringent conditions are known to those skilled in the art and can be found, for example, in Current Protocols in Molecular Biology, John Wiley & Sons, N.Y., 6.3.1-6.3.6 (1989). Aqueous and non-aqueous methods are described in that reference and either can be used. An example of stringent hybridization conditions is hybridization in 6× sodium chloride/sodium citrate (SSC) at about 45° C., followed by one or more washes in 0.2×SSC, 0.1% SDS at 50° C. Another example of stringent hybridization conditions are hybridization in 6× sodium chloride/sodium citrate (SSC) at about 45° C., followed by one or more washes in 0.2×SSC, 0.1% SDS at 55° C. A further example of stringent hybridization conditions is hybridization in 6× sodium chloride/sodium citrate (SSC) at about 45° C., followed by one or more washes in 0.2×SSC, 0.1% SDS at 60° C. Often, stringent hybridization conditions are hybridization in 6× sodium chloride/sodium citrate (SSC) at about 45° C., followed by one or more washes in 0.2×SSC, 0.1% SDS at 65° C. More often, stringency conditions are 0.5M sodium phosphate, 7% SDS at 65° C., followed by one or more washes at 0.2×SSC, 1% SDS at 65° C.

A nucleic acid or polypeptide for use in developing cells and organisms and/or methods described herein may be, for example, a polynucleotide or amino acid sequence that is homologous or identical to a nucleotide sequence (or complement thereof) or amino acid sequence provided herein over at least about 75%, or at least about 77%, or at least about 78%, or at least about 79%, or at least about 80%, or at least about 85%, or at least about 90%, or at least about 95% or more of the provided reference sequence. For example, a polynucleotide or polypeptide can be one that is at least about 50%, or at least about 51%, or at least about 52%, or at least about 54%, or at least about 55%, or at least about 58%, or at least about 60%, or at least about 62%, or at least about 65%, or at least about 70%, or at least about 75% or at least about 80% or more homologous or identical to a nucleic acid (or complement thereof) or polypeptide provided herein over the specified extent of a nucleic acid or polypeptide provided herein. In another embodiment, a nucleic acid or polypeptide can be one that is homologous or identical to a nucleic acid (or complement thereof) or polypeptide provided herein over at least about 86%, or at least about 87%, or at least about 88%, or at least about 89%, or at least about 92%, or at least about 97% or more of the provided reference nucleic acid (or complement thereof) or polypeptide. For example, the protein can be one that is at least about 67%, or at least about 68%, or at least about 69%, or at least about 72%, or at least about 77%, or at least about 82%, or at least about 87%, or at least about 90%, or at least about 95% or at least about 96%, or at least about 97%, or at least about 98%, or at least about 99% or more homologous or identical to a reference nucleic acid (or complement thereof) or polypeptide provided herein over the specified extent of the nucleic acid (or complement thereof) or polypeptide.

In some embodiments, a nucleotide or amino acid sequence that is at least 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more identical to a nucleotide sequence (or complement thereof) or amino acid sequence described herein can be utilized. The term "identical" as used herein refers to two or more nucleotide or amino acid sequences having substantially the same nucleotide or amino acid sequence when compared to each other. One test for determining whether two nucleotide sequences or amino acids sequences are substantially identical is to determine the percent of identical nucleotide sequences or amino acid sequences shared.

Target Nucleotide Sequence

A nucleic acid reagent sometimes can comprise a target nucleotide sequence. A "target nucleotide sequence" as used herein encodes a nucleic acid, peptide, polypeptide or protein of interest, and may be a ribonucleotide sequence or a deoxyribonucleotide sequence. A target nucleic acid sometimes is an untranslated ribonucleic acid and sometimes is a translatable ribonucleic acid. An untranslated ribonucleic acid may include, but is not limited to, a small interfering ribonucleic acid (siRNA), a short hairpin ribonucleic acid (shRNA), other ribonucleic acid capable of RNA interference (RNAi), an antisense ribonucleic acid, or a ribozyme. A translatable target nucleotide sequence (e.g., a target ribonucleotide sequence) sometimes encodes a peptide, polypeptide or protein, which are sometimes referred to herein as "target peptides," "target polypeptides" or "target proteins."

Any peptides, polypeptides or proteins, or an activity catalyzed by one or more peptides, polypeptides or proteins, may be encoded by a target nucleotide sequence and may be selected by a user. Representative proteins include enzymes (e.g., acetyl-CoA carboxylase, acyl-CoA oxidase, thioesterase, monooxygenase, monooxygenase reductase, fatty alcohol oxidase, acyltransferase and the like, for example), antibodies, serum proteins (e.g., albumin), membrane bound proteins, hormones (e.g., growth hormone, erythropoietin, insulin, and the like), cytokines, and the like, and include both naturally occurring and exogenously expressed polypeptides. Representative activities (e.g., enzymes or combinations of enzymes which are functionally associated to provide an activity) include thioesterase activity, monooxygenase activity, monooxygenase reductase activity, acetyltransferase activity, omega hydroxyl fatty acid dehydrogenase activity, beta-oxidation activity, omega-oxidation activity and the like, for example. The term "enzyme" as used herein refers to a protein which can act as a catalyst to induce a chemical change in other compounds, thereby producing one or more products from one or more substrates.

Specific polypeptides (e.g., enzymes) useful for embodiments described herein are listed herein. The term "protein" as used herein refers to a molecule having a sequence of amino acids linked by peptide bonds. This term includes fusion proteins, oligopeptides, peptides, cyclic peptides, polypeptides and polypeptide derivatives, whether native or recombinant, and also includes fragments, derivatives, homologs, and variants thereof. A protein or polypeptide sometimes is of intracellular origin (e.g., located in the nucleus, cytosol, organelle (e.g., mitochondria or peroxisome) or interstitial space of host cells in vivo) and sometimes is a cell membrane protein in vivo. In some embodiments (described in further detail herein), a genetic modification can result in a modification (e.g., increase, substantially increase, decrease or substantially decrease) of a target activity and/or in a modification of a cellular location for a protein.

A translatable nucleotide sequence generally is located between a start codon (AUG in ribonucleic acids and ATG in deoxyribonucleic acids) and a stop codon (e.g., UAA (ochre), UAG (amber) or UGA (opal) in ribonucleic acids and TAA, TAG or TGA in deoxyribonucleic acids), and sometimes is referred to herein as an "open reading frame" (ORF). A translatable nucleotide sequence (e.g., ORF) sometimes is encoded differently in one organism (e.g., most organisms encode CTG as leucine) than in another organism (e.g., *Candida tropicalis* and *Candida viswanathii* encode CTG as serine). In some embodiments, a translatable nucleotide sequence is altered to correct alternate genetic code (e.g., codon usage) differences between a nucleotide donor organism and a nucleotide recipient organism (e.g., engineered organism). In certain embodiments, a translatable nucleotide sequence is altered to improve: (i) codon usage, (ii) transcriptional efficiency, (iii) translational efficiency, (iv) the like, and combinations thereof.

Nucleic Acid Reagents and Tools

A nucleic acid reagent sometimes includes one or more ORFs. An ORF may be from any suitable source, sometimes from genomic DNA, mRNA, reverse transcribed RNA or complementary DNA (cDNA) or a nucleic acid library comprising one or more of the foregoing, and is from any organism species that contains a nucleic acid sequence of interest, protein of interest, or activity of interest. Non-limiting examples of organisms from which an ORF can be obtained include bacteria, yeast, fungi, plant, human, insect, nematode, bovine, equine, canine, feline, rat or mouse, for example.

A nucleic acid reagent sometimes contains a nucleotide sequence adjacent to an ORF that is translated in conjunction with the ORF and encodes an amino acid tag. The tag-encoding nucleotide sequence can be located 3' and/or 5' of an ORF in the nucleic acid reagent, thereby encoding a tag at the C-terminus or N-terminus of the protein or peptide encoded by the ORF. Any tag that does not abrogate in vitro transcription and/or translation may be utilized and may be appropriately selected by the artisan. Tags may facilitate isolation and/or purification of the desired ORF product from culture or fermentation media.

A tag sometimes specifically binds a molecule or moiety of a solid phase or a detectable label, for example, thereby having utility for isolating, purifying and/or detecting a protein or peptide encoded by the ORF. In some embodiments, a tag includes one or more of the following elements: FLAG (e.g., DYKDDDDKG), V5 (e.g., GKPIPNPLLGLDST), c-MYC (e.g., EQKLISEEDL), HSV (e.g., QPELAPEDPED), influenza hemaglutinin, HA (e.g., YPYDVPDYA), VSV-G (e.g., YTDIEMNRLGK), bacterial glutathione-S-transferase, maltose binding protein, a streptavidin- or avidin-binding tag (e.g., pcDNA™6 BioEase™ Gateway® Biotinylation System (ThermoFisher Scientific)), thioredoxin, β-galactosidase, VSV-glycoprotein, a fluorescent protein (e.g., green fluorescent protein or one of its many color variants (e.g., yellow, red, blue)), a polylysine or polyarginine sequence, a polyhistidine sequence (e.g., His6) or other sequence that chelates a metal (e.g., cobalt, zinc, copper), and/or a cysteine-rich sequence that binds to an arsenic-containing molecule. In certain embodiments, a cysteine-rich tag comprises the amino acid sequence CC-Xn-CC, where X is any amino acid and n is 1 to 3, and the cysteine-rich sequence sometimes is CCPGCC. In certain embodiments, the tag contains a cysteine-rich element and a polyhistidine element (e.g., CCPGCC and His6).

A tag often conveniently binds to a binding partner. For example, some tags bind to an antibody (e.g., FLAG) and sometimes specifically bind to a small molecule. For example, a polyhistidine tag specifically chelates a bivalent metal, such as copper, zinc and cobalt; a polylysine or polyarginine tag specifically binds to a zinc finger; a glutathione S-transferase tag binds to glutathione; and a cysteine-rich tag specifically binds to an arsenic-containing molecule. Arsenic-containing molecules include LUMIO™ agents (ThermoFisher Scientific), such as FlAsH™ (EDT2[4',5'-bis (1,3,2-dithioarsolan-2-yl)fluorescein-(1,2-ethanedithiol)2]) and ReAsH reagents (e.g., U.S. Pat. No. 5,932,474 to Tsien et al., entitled "Target Sequences for Synthetic Molecules;" U.S. Pat. No. 6,054,271 to Tsien et al., entitled "Methods of Using Synthetic Molecules and Target Sequences;" U.S. Pat. Nos. 6,451,569 and 6,008,378; published U.S. Patent Application 2003/0083373, and published PCT Patent Application WO 99/21013, all to Tsien et al. and all entitled "Synthetic Molecules that Specifically React with Target Sequences"). Such antibodies and small molecules sometimes are linked to a solid phase for convenient isolation of the target protein or target peptide.

A tag sometimes includes a sequence that localizes a translated protein or peptide to a component in a system, which may be referred to as a "signal sequence," "targeting sequence" or "localization signal sequence" herein. A signal sequence often is incorporated at the N-terminus of a target protein or target peptide, and sometimes is incorporated at the C-terminus. Examples of signal sequences are known to the artisan, are readily incorporated into a nucleic acid reagent, and often are selected according to the organism in which expression of the nucleic acid reagent is performed. A signal sequence in some embodiments localizes a translated protein or peptide to a cell membrane. Examples of signal sequences include, but are not limited to, a nucleus targeting signal (e.g., steroid receptor sequence and N-terminal sequence of SV40 virus large T antigen); mitochondrial targeting signal (e.g., amino acid sequence that forms an amphipathic helix); peroxisome targeting signal (e.g., C-terminal sequence in YFG from *S. cerevisiae*); and a secretion signal (e.g., N-terminal sequences from invertase, mating factor alpha, PHO5 and SUC2 in *S. cerevisiae*; multiple N-terminal sequences of *B. subtilis* proteins (e.g., Tjalsma et al., *Microbiol. Molec. Biol. Rev.* 64: 515-547 (2000)); alpha amylase signal sequence (e.g., U.S. Pat. No. 6,288,302); pectate lyase signal sequence (e.g., U.S. Pat. No. 5,846,818); precollagen signal sequence (e.g., U.S. Pat. No. 5,712,114); OmpA signal sequence (e.g., U.S. Pat. No.

5,470,719); lam beta signal sequence (e.g., U.S. Pat. No. 5,389,529); *B. brevis* signal sequence (e.g., U.S. Pat. No. 5,232,841); and *P. pastoris* signal sequence (e.g., U.S. Pat. No. 5,268,273)).

A tag sometimes is directly adjacent to the amino acid sequence encoded by an ORF (i.e., there is no intervening sequence) and sometimes a tag is substantially adjacent to an ORF encoded amino acid sequence (e.g., an intervening sequence is present). An intervening sequence sometimes includes a recognition site for a protease, which is useful for cleaving a tag from a target protein or peptide. In some embodiments, the intervening sequence is cleaved by Factor Xa (e.g., recognition site I (E/D)GR), thrombin (e.g., recognition site LVPRGS), enterokinase (e.g., recognition site DDDDK), TEV protease (e.g., recognition site ENLYFQG) or PreScission™ protease (e.g., recognition site LEVLFQGP), for example.

An intervening sequence sometimes is referred to herein as a "linker sequence," and may be of any suitable length selected by the artisan. A linker sequence sometimes is about 1 to about 20 amino acids in length, and sometimes about 5 to about 10 amino acids in length. The linker length can be selected to substantially preserve target protein or peptide function (e.g., a tag may reduce target protein or peptide function unless separated by a linker), to enhance disassociation of a tag from a target protein or peptide when a protease cleavage site is present (e.g., cleavage may be enhanced when a linker is present), and to enhance interaction of a tag/target protein product with a solid phase. A linker can be of any suitable amino acid content, and often comprises a higher proportion of amino acids having relatively short side chains (e.g., glycine, alanine, serine and threonine).

A nucleic acid reagent sometimes includes a stop codon between a tag element and an insertion element or ORF, which can be useful for translating an ORF with or without the tag. Mutant tRNA molecules that recognize stop codons suppress translation termination and thereby are designated "suppressor tRNAs." Suppressor tRNAs can result in the insertion of amino acids and continuation of translation past stop codons (e.g., U.S. Patent Application No. 60/587,583, filed Jul. 14, 2004, entitled "Production of Fusion Proteins by Cell-Free Protein Synthesis,"; Eggertsson, et al., (1988) *Microbiological Review* 52(3):354-374, and Engleerg-Kukla, et al. (1996) in *Escherichia coli* and *Salmonella* Cellular and Molecular Biology, Chapter 60, pps 909-921, Neidhardt, et al. eds., ASM Press, Washington, DC). A number of suppressor tRNAs are known, including but not limited to, supE, supP, supD, supF and supZ suppressors, which suppress the termination of translation of the amber stop codon; supB, gIT, supL, supN, supC and supM suppressors, which suppress the function of the ochre stop codon and glyT, trpT and Su-9 suppressors, which suppress the function of the opal stop codon. In general, suppressor tRNAs contain one or more mutations in the anti-codon loop of the tRNA that allows the tRNA to base pair with a codon that ordinarily functions as a stop codon. The mutant tRNA is charged with its cognate amino acid residue and the cognate amino acid residue is inserted into the translating polypeptide when the stop codon is encountered. Mutations that enhance the efficiency of termination suppressors (i.e., increase stop codon read-through) have been identified. These include, but are not limited to, mutations in the uar gene (also known as the prfA gene), mutations in the ups gene, mutations in the sueA, sueB and sueC genes, mutations in the rpsD (ramA) and rpsE (spcA) genes and mutations in the rplL gene.

Thus, a nucleic acid reagent containing a stop codon located between an ORF and a tag can yield a translated ORF alone when no suppressor tRNA is present in the translation system, and can yield a translated ORF-tag fusion when a suppressor tRNA is present in the system.

Suppressor tRNA can be generated in cells transfected with a nucleic acid encoding the tRNA (e.g., a replication incompetent adenovirus containing the human tRNA-Ser suppressor gene can be transfected into cells, or a YAC containing a yeast or bacterial tRNA suppressor gene can be transfected into yeast cells, for example). Vectors for synthesizing suppressor tRNA and for translating ORFs with or without a tag are available to the artisan (e.g., Tag-On-Demand™ kit (ThermoFisher Scientific); Tag-On-Demand™ Suppressor Supernatant Instruction Manual, Version C, 31 Oct. 2010, World Wide Web Uniform Resource Locator (URL) tools.thermofisher.com/content/sfs/manuals/tagondemand_supernatant_man.pdf; Tag-On-Demand™ Gateway® Vector Instruction Manual, Version D, 31 Oct. 2010 World Wide Web Uniform Resource Locator (URL) tools.thermofisher.com/content/sfs/manuals/tagondemand-_vectors_man.pdf; and Capone et al. (1985) Amber, ochre and opal suppressor tRNA genes derived from a human serine tRNA gene. *EMBO J.* 4:213).

Any convenient cloning strategy known in the art may be utilized to incorporate an element, such as an ORF, into a nucleic acid reagent. Known methods can be utilized to insert an element into the template independent of an insertion element, such as (1) cleaving the template at one or more existing restriction enzyme sites and ligating an element of interest and (2) adding restriction enzyme sites to the template by hybridizing oligonucleotide primers that include one or more suitable restriction enzyme sites and amplifying by polymerase chain reaction. Other cloning strategies take advantage of one or more insertion sites present or inserted into the nucleic acid reagent, such as an oligonucleotide primer hybridization site for PCR, for example, and others described herein. In some embodiments, a cloning strategy can be combined with genetic manipulation such as recombination (e.g., recombination of a nucleic acid reagent with a nucleic acid sequence of interest into the genome of the organism that is modified, as described further herein). In some embodiments, the cloned ORF(s) can produce (directly or indirectly), for example, a fatty acid or dicarboxylic acid (e.g., adipic acid, octanedioic acid, decanedioic acid, dodecanedioic acid, tetradecanedioic acid, hexadecanedioic acid, octadecanedioic acid, eicosanedioic acid), 3-hydroxyproprionic acid, triacetic acid lactone, by engineering a cell or microorganism with one or more ORFs of interest, which cell or microorganism may include one or more altered activities such as, for example, carnitine acetyltransferase activity, acetyl-CoA carboxylase activity, ATP citrate lyase activity, acetyl-CoA synthetase activity, cytochrome P450 reductase activity, acetyl-CoA hydrolase activity, 6-oxohexanoic acid dehydrogenase activity, 6-hydroxyhexanoic acid dehydrogenase activity, glucose-6-phosphate dehydrogenase activity, hexanoate synthase activity, lipase activity, fatty acid synthase activity, omega hydroxyl fatty acid dehydrogenase activity, acyl-CoA oxidase activity, acyltransferase activity, thioesterase activity, monooxygenase activity and monooxygenase reductase activity.

In some embodiments, a nucleic acid reagent includes one or more recombinase insertion sites. A recombinase insertion site is a recognition sequence on a nucleic acid molecule that participates in an integration/recombination reaction by recombination proteins. For example, the recombination site for Cre recombinase is loxP, which is a 34 base pair sequence comprised of two 13 base pair inverted repeats (serving as the recombinase binding sites) flanking an 8 base pair core sequence (e.g., FIG. 1 of Sauer, B., Curr. Opin. Biotech. 5:521-527 (1994)). Other examples of recombination sites include attB, attP, attL, and attR sequences, and mutants, fragments, variants and derivatives thereof, which are recognized by the recombination protein λ Int and by the auxiliary proteins integration host factor (IHF), FIS and excisionase (Xis) (e.g., U.S. Pat. Nos. 5,888,732; 6,143,557; 6,171,861; 6,270,969; 6,277,608; and 6,720,140; U.S. patent application Ser. No. 09/517,466, filed Mar. 2, 2000, and Ser. No. 09/732,914, filed Aug. 14, 2003, and in U.S. patent publication no. 2002-0007051-A1; Landy, Curr. Opin. Biotech. 3:699-707 (1993)).

Examples of recombinase cloning nucleic acids are in Gateway® systems (ThermoFisher Scientific), which include at least one recombination site for cloning a desired nucleic acid molecules in vivo or in vitro. In some embodiments, the system utilizes vectors that contain at least two different site-specific recombination sites, often based on the bacteriophage lambda system (e.g., att1 and att2), and are mutated from the wild-type (att0) sites. Each mutated site has a unique specificity for its cognate partner att site (i.e., its binding partner recombination site) of the same type (for example attB1 with attP1, or attL1 with attR1) and will not cross-react with recombination sites of the other mutant type or with the wild-type att0 site. Different site specificities allow directional cloning or linkage of desired molecules thus providing desired orientation of the cloned molecules. Nucleic acid fragments flanked by recombination sites are cloned and subcloned using the Gateway® system by replacing a selectable marker (for example, ccdB) flanked by att sites on the recipient plasmid molecule, sometimes termed the Destination Vector. Desired clones are then selected by transformation of a ccdB sensitive host strain and positive selection for a marker on the recipient molecule. Similar strategies for negative selection (e.g., use of toxic genes) can be used in other organisms such as thymidine kinase (TK) in mammals and insects.

A recombination system useful for engineering yeast is outlined briefly. The system makes use of the URA3 gene (e.g., for *Candida tropicalis*, *Candida viswanathii*, *Saccharomyces cerevisiae* and *Candida albicans*, for example) or URA4 and URA5 genes (e.g., for *S. pombe*, for example) and toxicity of the nucleotide analogue 5-Fluoroorotic acid (5-FOA). The URA3 or URA4 and URA5 genes encode orotidine-5'-monophosphate (OMP) dicarboxylase. Yeast with an active URA3 or URA4 and URA5 gene (phenotypically Ura+) convert 5-FOA to fluorodeoxyuridine, which is toxic to yeast cells. Yeast carrying a mutation in the appropriate gene(s) or having a knock out of the appropriate gene(s) can grow in the presence of 5-FOA, if the media is also supplemented with uracil.

A nucleic acid engineering construct can be made which may contain the URA3 gene or cassette (for *C. tropicalis*, *C. viswanathii* or *S. cerevisiae*, for example), flanked on either side by the same nucleotide sequence in the same orientation. The URA3 cassette can include a promoter, the URA3 gene and a functional transcription terminator. Target sequences which direct the construct to a particular nucleic acid region of interest in the cell or organism to be engineered are added such that the target sequences are adjacent to and abut the flanking sequences on either side of the URA3 cassette. Yeast can be transformed with the engineered construct and plated on minimal media without uracil. Colonies can be screened by PCR to determine those transformants that have the engineering construct inserted in the proper location in the genome. Checking insertion location prior to selecting for recombination of the ura3 cassette may reduce the number of incorrect clones carried through to later stages of the procedure. Correctly inserted transformants can then be grown and plated on minimal media containing 5-FOA to select for recombination of the URA3 cassette out of the construct, leaving a disrupted gene and an identifiable footprint (e.g., nucleic acid sequence) that can be used to verify the presence of the disrupted gene. The technique described is useful for disrupting or "knocking out" gene function, but also can be used to insert genes or constructs into a host cell genome in a targeted, sequence specific manner.

In certain embodiments, a nucleic acid reagent includes one or more topoisomerase insertion sites. A topoisomerase insertion site is a defined nucleotide sequence recognized and bound by a site-specific topoisomerase. For example, the nucleotide sequence 5'-(C/T)CCTT-3' is a topoisomerase recognition site bound specifically by most poxvirus topoisomerases, including vaccinia virus DNA topoisomerase I. After binding to the recognition sequence, the topoisomerase cleaves the strand at the 3'-most thymidine of the recognition site to produce a nucleotide sequence comprising 5'-(C/T)CCTT-PO4-TOPO, a complex of the topoisomerase covalently bound to the 3' phosphate via a tyrosine in the topoisomerase (e.g., Shuman (1991) *J. Biol. Chem.* 266:11372-11379; Sekiguchi and Shuman (1994) *Nucl. Acids Res.* 22:5360-5365; U.S. Pat. No. 5,766,891; PCT/US95/16099; and PCT/US98/12372). In comparison, the nucleotide sequence 5'-GCAACTT-3' is a topoisomerase recognition site for type IA *E. coli* topoisomerase III. An element that is inserted often is combined with topoisomerase-reacted template and thereby incorporated into the nucleic acid reagent (e.g., World Wide Web Uniform Resource Locator (URL) tools.thermofisher.com/downloads/F-13512_Topo_Flyer.pdf; World Wide Web Uniform Resource Locator (URL) tools.thermofisher.com/content/sfs/brochures/topo-per-cloning-brochure.pdf; TOPO TA Cloning® Kit and Zero Blunt® TOPO® Cloning Kit product information).

A nucleic acid reagent sometimes contains one or more origin of replication (ORI) elements. In some embodiments, a template comprises two or more ORIs, where one functions efficiently in one organism (e.g., a bacterium) and another functions efficiently in another organism (e.g., a eukaryote, like yeast for example). In some embodiments, an ORI may function efficiently in one species (e.g., *S. cerevisiae*, for example) and another ORI may function efficiently in a different species (e.g., *S. pombe*, for example). A nucleic acid reagent also sometimes includes one or more transcription regulation sites.

A nucleic acid reagent can include one or more selection elements (e.g., elements for selection of the presence of the nucleic acid reagent, and not for activation of a promoter element which can be selectively regulated). Selection elements often are utilized using known processes to determine whether a nucleic acid reagent is included in a cell. In some embodiments, a nucleic acid reagent includes two or more selection elements, where one functions efficiently in one organism and another functions efficiently in another organism. Examples of selection elements include, but are not limited to, (1) nucleic acid segments that encode products that provide resistance against otherwise toxic compounds (e.g., antibiotics); (2) nucleic acid segments that encode products that are otherwise lacking in the recipient cell (e.g., essential products, tRNA genes, auxotrophic markers); (3)

nucleic acid segments that encode products that suppress the activity of a gene product; (4) nucleic acid segments that encode products that can be readily identified (e.g., phenotypic markers such as antibiotics (e.g., β-lactamase), β-galactosidase, green fluorescent protein (GFP), yellow fluorescent protein (YFP), red fluorescent protein (RFP), cyan fluorescent protein (CFP), and cell surface proteins); (5) nucleic acid segments that bind products that are otherwise detrimental to cell survival and/or function; (6) nucleic acid segments that otherwise inhibit the activity of any of the nucleic acid segments described in Nos. 1-5 above (e.g., antisense oligonucleotides); (7) nucleic acid segments that bind products that modify a substrate (e.g., restriction endonucleases); (8) nucleic acid segments that can be used to isolate or identify a desired molecule (e.g., specific protein binding sites); (9) nucleic acid segments that encode a specific nucleotide sequence that can be otherwise nonfunctional (e.g., for PCR amplification of subpopulations of molecules); (10) nucleic acid segments that, when absent, directly or indirectly confer resistance or sensitivity to particular compounds; (11) nucleic acid segments that encode products that either are toxic or convert a relatively non-toxic compound to a toxic compound (e.g., Herpes simplex thymidine kinase, cytosine deaminase) in recipient cells; (12) nucleic acid segments that inhibit replication, partition or heritability of nucleic acid molecules that contain them; and/or (13) nucleic acid segments that encode conditional replication functions, e.g., replication in certain hosts or host cell strains or under certain environmental conditions (e.g., temperature, nutritional conditions, and the like). In some embodiments, the regulatory or selective agent can be added to change the existing growth conditions to which a cell or organism is subjected (e.g., growth in liquid culture, growth in a fermenter, growth on solid nutrient plates and the like for example).

A nucleic acid reagent can sometimes be of any form useful for in vivo transcription and/or translation. A nucleic acid sometimes is a plasmid, such as a supercoiled plasmid, sometimes is a yeast artificial chromosome (e.g., YAC), sometimes is a linear nucleic acid (e.g., a linear nucleic acid produced by PCR or by restriction digest), sometimes is single-stranded and sometimes is double-stranded. A nucleic acid reagent sometimes is prepared by an amplification process, such as a polymerase chain reaction (PCR) process or transcription-mediated amplification process (TMA). In TMA, two enzymes are used in an isothermal reaction to produce amplification products detected by light emission (see, e.g., Biochemistry 1996 Jun. 25; 35(25):8429-38). Standard PCR processes are known (e.g., U.S. Pat. Nos. 4,683,202; 4,683,195; 4,965,188; and 5,656,493), and generally are performed in cycles. Each cycle includes heat denaturation, in which hybrid nucleic acids dissociate; cooling, in which primer oligonucleotides hybridize; and extension of the oligonucleotides by a polymerase (i.e., Taq polymerase). An example of a PCR cyclical process is treating the sample at 95° C. for 5 minutes; repeating forty-five cycles of 95° C. for 1 minute, 59° C. for 1 minute, 10 seconds, and 72° C. for 1 minute 30 seconds; and then treating the sample at 72° C. for 5 minutes. Multiple cycles frequently are performed using a commercially available thermal cycler. PCR amplification products sometimes are stored for a time at a lower temperature (e.g., at 4° C.) and sometimes are frozen (e.g., at −20° C.) before analysis.

In some embodiments, a nucleic acid reagent, protein reagent, protein fragment reagent or other reagent described herein is isolated or purified. The term "isolated" as used herein refers to material removed from its original environment (e.g., the natural environment if it is naturally occurring, or a host cell if expressed exogenously), and thus is altered "by the hand of man" from its original environment. The term "purified" as used herein with reference to molecules does not refer to absolute purity. Rather, "purified" refers to a substance in a composition that contains fewer substance species in the same class (e.g., nucleic acid or protein species) other than the substance of interest in comparison to the sample from which it originated. "Purified," if a nucleic acid or protein for example, refers to a substance in a composition that contains fewer nucleic acid species or protein species other than the nucleic acid or protein of interest in comparison to the sample from which it originated. Sometimes, a protein or nucleic acid is "substantially pure," indicating that the protein or nucleic acid represents at least 50% of protein or nucleic acid on a mass basis of the composition. Often, a substantially pure protein or nucleic acid is at least 75% on a mass basis of the composition, and sometimes at least 95% on a mass basis of the composition.

Genetic Engineering Methods

Methods and compositions (e.g., nucleic acid reagents) described herein can be used to generate modified or engineered cells or organisms. For example, a cell or organism can be modified by altering one or more cellular activities and/or the sum total of a cell's or organism's activities. Modifications can be, for example, any alteration of cellular activities, including addition of cellular activities and/or elimination of cellular activities. The term "altered activity" as used herein refers to an activity in an engineered cell or microorganism that is added, removed or modified in any way relative to the host cell or microorganism (e.g., added, increased, reduced, decreased, inhibited, removed or redirected activity). In some embodiments, the methods and nucleic acid reagents described herein can be used to generate genetically modified cells and organisms with altered activities in cellular carbon processing.

For example, the methods of genetic modification can be used to alter fatty acid (e.g., oleic acid, adipic acid, sebacic acid, suberic acid, octanedioic acid, decanedioic acid, dodecanedioic acid, tetradecanedioic acid, hexadecanedioic acid, octadecanedioic acid, eicosanedioic acid) synthesis and/or catabolism. In some embodiments, an engineered cell or organism described herein may include an increased number of copies of one or more polynucleotides encoding one or more polypeptides having carnitine acetyltransferase, acetyl-CoA carboxylase, ATP citrate lyase, thioesterase, acetyl-CoA hydrolase, acetyl-CoA synthetase, acyl-CoA oxidase, cytochrome P450 reductase, monooxygenase, peroxisomal biogenesis factor, alcohol dehydrogenase, alcohol oxidase, aldehyde dehydrogenase, 3-ketoacyl-CoA thiolase, and/or multifunctional enzyme (e.g., enoyl-CoA hydratase and/or 3-hydroxyacyl-CoA dehydrogenase) activity. In certain embodiments, an engineered cell or microorganism described herein may include one or more genetic modifications that reduce one or more of the following activities: carnitine acetyltransferase (e.g., mitochondrial), acetyl-carnitine translocase (e.g., mitochondrial), acyl-CoA synthetase, acyl-CoA oxidase and peroxisomal transporter activity.

In some embodiments, the engineered cell or organism can be a prokaryote. In certain embodiments, the prokaryote can be a bacterium, e.g., *Escherichia coli*. In some embodiments, the engineered cell or organism can be a eukaryote. In some embodiments, the eukaryote may be a fungus. In certain embodiments, the eukaryote can be a yeast. In certain embodiments, the yeast can be a *Candida* yeast. In some embodiments, the *Candida* yeast may be *C. viswanathii* or *C. troplicalis*. In certain embodiments, the fungus can be a *Yarrowia* fungus. In some embodiments the *Yarrowia* fungus may be *Y. lipolytica*. In some embodiments, the fungus can be a *Blastobotrys* yeast, e.g., *B. adeninivorans*. In certain embodiments, the fungus can be an *Aspergillus* fungus. In some embodiments, the *Aspergillus* fungus may be *A. parasiticus* or *A. nidulans*.

In some embodiments, an activity and/or amount of a composition can be altered by genetically modifying a host cell or organism which yields an engineered cell or organism having added, increased, reduced, decreased, inhibited, redirected, removed and/or otherwise modified activity or composition. A cell or organism may be modified, for example, by altering the amount of one or more cellular compositions, e.g, polynucleotides and/or polypeptides. Engineered cells or organisms typically arise as a result of a genetic modification, usually introduced by one of skill in the art using readily available techniques. Such cells or organisms are referred to herein as genetically modified or genetically engineered cells, microorganisms or organisms. The term "genetic modification" as used herein refers to any alteration in the genetic make-up of a cell or organism, including, for example, any nucleic acid addition, removal or alteration. Genetic modifications include, without limitation, insertion of one or more nucleotides in an endogenous nucleic acid of a host cell or organism in one or more locations, deletion of one or more nucleotides in an endogenous nucleic acid of a host cell or organism in one or more locations, modification or substitution of one or more nucleotides in an endogenous nucleic acid of a host cell or organism in one or more locations. In some embodiments, a portion of a host genome can be replaced with a heterologous nucleic acid. A genetic modification can also be insertion of a nucleic acid into a host cell organism that is distinct from the host endogenous genome (e.g., insertion of an autonomously replicating vector), and removal of a nucleic acid that is distinct from the endogenous host genome (e.g., removal of a vector).

Non-limiting examples of methods useful for genetically modifying a cell or organism include, introducing a heterologous polynucleotide (e.g., nucleic acid or gene integration, also referred to as "knock in"), removing an endogenous polynucleotide, altering the sequence of an existing endogenous nucleic acid sequence (e.g., site-directed mutagenesis), disruption of an existing endogenous nucleic acid sequence (e.g., knock outs and transposon or insertion element mediated mutagenesis), selection for an altered activity where the selection causes a change in a naturally occurring activity that can be stably inherited (e.g., causes a change in a nucleic acid sequence in the genome of the cell or organism or in an epigenetic nucleic acid that is replicated and passed on to daughter cells), PCR-based mutagenesis, and the like. The terms "mutant" and "mutagenesis" as used herein refer to any modification to a nucleic acid (e.g., nucleic acid reagent or host chromosome) and/or polypeptide which results in an altered nucleic acid and/or polypeptide. Non-limiting examples of mutagenesis include, deletion, insertion, substitution, rearrangement, point mutations, suppressor mutations and the like of a single or multiple residues in a polynucleotide. Mutagenesis methods are known in the art and are readily available to the artisan. Non-limiting examples of mutagenesis methods are described herein and can also be found in Maniatis, T., E. F. Fritsch and J. Sambrook (1982) *Molecular Cloning: a Laboratory Manual*; Cold Spring Harbor Laboratory, Cold Spring Harbor, N.Y. Another non-limiting example of mutagenesis can be conducted using an Agilent (Santa Clara, CA) "QuickChange" kit according to the manufacturer's instructions.

Decreasing an Amount of a Composition and/or Activity in a Cell

An altered activity or composition sometimes is an activity or composition detectable in a host cell or organism and that is reduced, decreased, inhibited or removed (i.e., not detectable) in an engineered cell or organism. For example, a genetic modification that disrupts cellular synthesis of a composition (e.g., acyl-CoA synthetase protein) and/or or disrupts an activity, such as activation of fatty acids, or disrupts a polynucleotide that encodes a polypeptide that carries out a forward reaction in the activity (e.g., acyl-CoA synthetase activity), may render the composition (e.g., acyl-CoA synthetase protein) or activity, such as fatty acid activation, undetectable. The term "undetectable" as used herein refers to an amount of an analyte (including an activity) that is below the limits of detection, using know detection methods or assays (e.g., described herein). In certain embodiments, the genetic modification may partially reduce or decrease a composition or an activity. The term "reduces" or "decreases" with reference to a composition or an activity as used herein refers to a level of the composition or activity in an engineered cell or organism that is lower than the level of the composition or activity found in the host or starting cell or organism. A "lower" level can be a level that is detectable or undetectable. The term "partially reduces" or "partially decreases" with reference to a composition or an activity as used herein refers to a level of the composition or activity in an engineered cell or organism that is lower than the level of the composition or activity found in the host or starting cell or organism but that is still detectable. Thus, an activity or composition can be reduced to undetectable levels in some embodiments, or detectable levels in certain embodiments. An activity or composition can be decreased to any suitable level for production of a target molecule product (e.g., an organic acid), including but not limited to less than 2-fold (e.g., about 10% decrease to about 99% decrease; about 20%, 30%, 40%, 50%, 60%, 70%, 80%, 90% decrease), 2-fold, 3-fold, 4-fold, 5-fold, 6-fold, 7-fold, 8-fold, 9-fold, of 10-fold decrease, or greater than about 10-fold decrease.

The term "level", as used herein, often refers to an amount (e.g., a quantitative or relative amount) of a nucleic acid (e.g. an RNA (e.g. an mRNA) or DNA), polypeptide or activity.

In some embodiments, an activity or composition may be reduced or removed by decreasing the number of copies of a polynucleotide that encodes a composition polypeptide or polypeptide having a target activity. In some embodiments, an activity or composition can be reduced or removed by (i) inserting a polynucleotide within a polynucleotide that encodes a protein having the target activity or the target composition (disruptive insertion), and/or (ii) removing a portion of or all of a polynucleotide that encodes a polypeptide having the target activity or the target composition (deletion or knock out, respectively). In certain embodiments, an activity or composition can be reduced or removed by inserting into a host cell or microorganism a heterologous polynucleotide that is (i) operably linked to another polynucleotide that encodes a polypeptide having the target activity or target composition, and (ii) down regulates production of the polypeptide. Thus, an activity or composition can be reduced or removed by inserting or modifying a regulatory polynucleotide operably linked to another polynucleotide that encodes a polypeptide having the target activity or target composition.

An activity or composition also can be reduced or removed by (i) inhibiting a polynucleotide that encodes a polypeptide having the activity or the targeted composition or (ii) inhibiting a polynucleotide operably linked to another polynucleotide that encodes a polypeptide having the activity or targeted composition. A polynucleotide can be inhibited by a suitable technique known in the art, such as by contacting an RNA encoded by the polynucleotide with a specific inhibitory RNA (e.g., RNAi, siRNA, ribozyme). An activity also can be reduced or removed by contacting a polypeptide having the activity with a molecule that specifically inhibits the activity (e.g., enzyme inhibitor, antibody). In certain embodiments, an activity or composition can be reduced or removed by subjecting a host cell or organism to a selective environment and screening for cells or organisms that have a reduced level or removal of the activity or composition.

In some embodiments, an untranslated ribonucleic acid or a cDNA can be used to reduce the expression of a particular activity or enzyme. For example, a host cell or organism can be engineered by genetic modification to express a nucleic acid reagent that reduces the expression of an activity by producing an RNA molecule that is partially or substantially homologous to a nucleic acid sequence of interest which encodes the activity of interest. The RNA molecule can bind to the nucleic acid sequence of interest and inhibit the nucleic acid sequence from performing its natural function, in certain embodiments. In some embodiments, the RNA may alter the nucleic acid sequence of interest which encodes the activity of interest in a manner that the nucleic acid sequence of interest is no longer capable of performing its natural function (e.g., the action of a ribozyme for example).

In some embodiments, an activity and/or composition may be reduced in, or removed from, a host cell or organism by increasing or adding a separate activity or composition in the host cell or organism. For example, an activity and/or composition that inhibits a targeted activity or composition in a host cell or organism can be increased or added thereby reducing or eliminating the targeted activity or composition by adding or increasing an inhibiting activity or composition. Methods of increasing or adding an activity or composition in a cell or organism are described herein.

Increasing an Amount of a Composition and/or Activity in a Cell

An altered activity and/or composition in an engineered cell or organism is sometimes an added composition or activity that is not detectable in a host cell or organism. An altered activity or composition can also be an increased or elevated activity or amount of a composition in an engineered cell or organism. An increased or elevated activity or composition generally is an activity or an amount of the composition that is greater than the activity or composition amount detectable in a host cell or organism. However, an increased or elevated activity or amount of a composition in an engineered cell or organism can also be a detectable activity or detectable composition that is not detectable in a host cell or organism. An activity or amount of a composition can be increased to any suitable level for example, for production of a target molecule product (e.g., an organic acid), including but not limited to less than 2-fold (e.g., about 10% increase to about 99% increase; about 20%, 30%, 40%, 50%, 60%, 70%, 80%, 90% increase), 2-fold, 3-fold, 4-fold, 5-fold, 6-fold, 7-fold, 8-fold, 9-fold, of 10-fold increase, or greater than about 10-fold increase.

In some embodiments, an activity and/or composition may be added to or increased in a host cell or organism by increasing the number of copies of a polynucleotide that encodes a polypeptide composition or polypeptide having the activity. In some embodiments, the activity and/or amount of a native or endogenous polypeptide can be increased by introducing heterologous nucleic acid into a host cell or organism that includes copies of a polynucleotide that encodes the polypeptide, for example, introducing 1 to about 100 additional heterologous copies of the polynucleotide (e.g., introducing 1 or more, 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 22 or more, 24 or more, 25 or more, 26 or more, 28 or more, 30 or more additional copies of the polynucleotide). In certain embodiments, an activity and/or composition can be added or increased by inserting into a host cell or organism a polynucleotide that encodes a heterologous polypeptide from a different species having the added activity or composition, or encodes a heterologous polypeptide that is a modified version of an endogenous polypeptide. In such embodiments, 1 to about 100 copies of the polynucleotide can be introduced (e.g., introducing 1 or more, 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 22 or more, 24 or more, 25 or more, 26 or more, 28 or more, 30 or more copies). A heterologous polypeptide that is a "modified endogenous polypeptide" often has an activity different than an activity of a native polypeptide counterpart (e.g., different catalytic activity and/or different substrate specificity), and often is active (e.g., an activity (e.g., substrate turnover) is detectable). A heterologous polypeptide that is a "modified endogenous polypeptide" also often includes or lacks a cell location-targeting amino acid sequence that a native polypeptide counterpart has or doesn't have (e.g., in order to modify the cellular location of the expressed polypeptide). In certain embodiments, an activity or composition can be added or increased by inserting into a host cell or organism a heterologous polynucleotide that is (i) operably linked to another polynucleotide that encodes a polypeptide composition or a polypeptide having the added activity, and (ii) up regulates production of the polypeptide. Thus, a composition or an activity can be added or increased by inserting or modifying a regulatory polynucleotide operably linked to another polynucleotide that encodes a composition polypeptide or polypeptide having the targeted activity. In certain embodiments, an activity or composition can be added or increased by subjecting a host cell or organism to a selective environment and screening for cells or organisms that have a detectable level of the activity or composition. Examples of a selective environment include, without limitation, a medium containing a substrate that a host cell or organism can process and a medium lacking a substrate that a host cell or organism can process.

In some embodiments, an activity and/or composition may be added to or increased in a host cell or organism by decreasing or removing a separate activity or composition in a host cell or organism. For example, an activity and/or composition in a host cell or organism that inhibits a desired target activity or composition can be decreased or removed thereby reducing or eliminating the inhibition of the desired activity or composition and adding or increasing the desired activity. Methods of decreasing or removing an activity or composition in a cell or organism are described herein.

Nucleic Acid Manipulation

In certain embodiments, nucleotide sequences sometimes are added to, modified or removed from one or more of the nucleic acid reagent elements, such as the promoter, 5' UTR, target sequence, or 3' UTR elements, to enhance, potentially enhance, reduce, or potentially reduce transcription and/or translation before or after such elements are incorporated in a nucleic acid reagent. In some embodiments, one or more of the following sequences may be modified or removed if they are present in a 5' UTR: a sequence that forms a stable secondary structure (e.g., quadruplex structure or stem loop stem structure (e.g., EMBL sequences X12949, AF274954, AF139980, AF152961, S95936, U194144, AF116649 or substantially identical sequences that form such stem loop stem structures)); a translation initiation codon upstream of the nucleotide sequence start codon; a stop codon upstream of the nucleotide sequence translation initiation codon; an ORF upstream of the nucleotide sequence translation initiation codon; an iron responsive element (IRE) or like sequence; and a 5' terminal oligopyrimidine tract (TOP, e.g., consisting of 5-15 pyrimidines adjacent to the cap). Computer-assisted software programs are available for nucleic acid sequence evaluation to optimize untranslated region sequences (see, e.g., World Wide Web Uniform Resource Locator (URL) bioinformatics.ua.pt/software/mrna-optimiser/). A translational enhancer sequence and/or an internal ribosome entry site (IRES) sometimes is inserted into a 5'UTR (e.g., EMBL nucleotide sequences J04513, X87949, M95825, M12783, AF025841, AF013263, AF006822, M17169, M13440, M22427, D14838 and M17446 and substantially identical nucleotide sequences).

An AU-rich element (ARE, e.g., AUUUA repeats) and/or splicing junction that follows a non-sense codon sometimes is removed from or modified in a 3' UTR. A polyadenosine tail sometimes is inserted into a 3' UTR if none is present, sometimes is removed if it is present, and adenosine moieties sometimes are added to or removed from a polyadenosine tail present in a 3' UTR. Thus, some embodiments are directed to a process that includes: determining whether any nucleotide sequences that increase, potentially increase, reduce or potentially reduce translation efficiency are present in the elements, and adding, removing or modifying one or more of such sequences if they are identified. Certain embodiments are directed to a process that includes: determining whether any nucleotide sequences that increase or potentially increase translation efficiency are not present in the elements, and incorporating such sequences into the nucleic acid reagent.

In some embodiments, an activity and/or composition can be altered by modifying the nucleotide sequence of an ORF. An ORF sometimes is mutated or modified (for example, by point mutation, deletion mutation, insertion mutation, PCR based mutagenesis and the like) to alter, enhance or increase, reduce, substantially reduce or eliminate the activity of the encoded protein or peptide. The protein or peptide encoded by a modified ORF sometimes is produced in a lower amount or may not be produced at detectable levels, and in other embodiments, the product or protein encoded by the modified ORF is produced at a higher level (e.g., codons sometimes are modified so they are compatible with tRNA's preferentially used in the host or engineered cell or organism). To determine the relative activity, the activity from the product of the mutated ORF (or cell containing it) can be compared to the activity of the product or protein encoded by the unmodified ORF (or cell containing it).

In some embodiments, an ORF nucleotide sequence sometimes is mutated or modified to alter the triplet nucleotide sequences used to encode amino acids (e.g., amino acid codon triplets, for example). Modification of the nucleotide sequence of an ORF to alter codon triplets sometimes is used to change the codon found in the original sequence to better match the preferred codon usage of the organism in which the ORF or nucleic acid reagent will be expressed. The codon usage, and therefore the codon triplets encoded by a nucleic acid sequence, in bacteria may be different from the preferred codon usage in eukaryotes, like yeast or plants for example. Preferred codon usage also may be different between bacterial species. In certain embodiments, an ORF nucleotide sequence sometimes is modified to eliminate codon pairs and/or eliminate mRNA secondary structures that can cause pauses during translation of the mRNA encoded by the ORF nucleotide sequence. Translational pausing sometimes occurs when nucleic acid secondary structures exist in an mRNA, and sometimes occurs due to the presence of codon pairs that slow the rate of translation by causing ribosomes to pause. In some embodiments, the use of lower abundance codon triplets can reduce translational pausing due to a decrease in the pause time needed to load a charged tRNA into the ribosome translation machinery. Therefore, to increase transcriptional and translational efficiency in bacteria (e.g., where transcription and translation are concurrent, for example) or to increase translational efficiency in eukaryotes (e.g., where transcription and translation are functionally separated), the nucleotide sequence of a nucleotide sequence of interest can be altered to better suit the transcription and/or translational machinery of the host and/or genetically modified cell or organism. In certain embodiments, slowing the rate of translation by the use of lower abundance codons, which slow or pause the ribosome, can lead to higher yields of the desired product due to an increase in correctly folded proteins and a reduction in the formation of inclusion bodies.

Codons can be altered and optimized according to the preferred usage by a given organism by determining the codon distribution of the nucleotide sequence donor organism and comparing the distribution of codons to the distribution of codons in the recipient or host organism. Techniques described herein (e.g., site directed mutagenesis and the like) can then be used to alter the codons accordingly. Comparisons of codon usage can be done by hand, or using nucleic acid analysis software commercially available to the artisan (see, e.g., World Wide Web Uniform Resource Locator (URL) kazusa.or.jp/codon/, World Wide Web Uniform Resource Locator (URL) jcat.de, World Wide Web Uniform Resource Locator (URL) idtdna.com/CodonOpt).

Modification of the nucleotide sequence of an ORF also can be used to correct codon triplet sequences that have diverged in different organisms. For example, certain yeast (e.g., *Candida tropicalis, Candida viswanathii* and *Candida maltosa*) use the amino acid triplet CUG (e.g., CTG in the DNA sequence) to encode serine. CUG typically encodes leucine in most organisms. In order to maintain the correct amino acid in the resultant polypeptide or protein, the CUG codon must be altered to reflect the organism in which the nucleic acid reagent will be expressed. Thus, if an ORF from a bacterial donor is expressed in such a *Candida* yeast strain mentioned above, the heterologous nucleotide sequence must first be altered or modified to the appropriate leucine codon. Therefore, in some embodiments, the nucleotide sequence of an ORF sometimes is altered or modified to correct for differences that have occurred in the evolution of the amino acid codon triplets between different organisms. In some embodiments, the nucleotide sequence can be left unchanged at a particular amino acid codon, if the amino acid encoded is a conservative or neutral change in amino acid when compared to the originally encoded amino acid.

In some embodiments, an activity can be altered by modifying translational regulation signals, like a stop codon for example. A stop codon at the end of an ORF sometimes is modified to another stop codon, such as an amber stop codon. In some embodiments, a stop codon is introduced within an ORF, sometimes by insertion or mutation of an existing codon. An ORF comprising a modified terminal stop codon and/or internal stop codon often is translated in a system comprising a suppressor tRNA that recognizes the stop codon. An ORF comprising a stop codon sometimes is translated in a system comprising a suppressor tRNA that incorporates an unnatural amino acid during translation of the target protein or target peptide. Methods for incorporating unnatural amino acids into a target protein or peptide are known, which include, for example, processes utilizing a heterologous tRNA/synthetase pair, where the tRNA recognizes an amber stop codon and is loaded with an unnatural amino acid (e.g., World Wide Web Uniform Resource Locator (URL) iupac.org/news/prize/2003/wang.pdf).

Depending on the portion of a nucleic acid reagent (e.g., promoter, 5' or 3' UTR, ORI, ORF, and the like) chosen for alteration (e.g., by mutagenesis, introduction or deletion, for example), the modifications described above can alter a given activity by (i) increasing or decreasing feedback inhibition mechanisms, (ii) increasing or decreasing promoter initiation, (iii) increasing or decreasing translation initiation, (iv) increasing or decreasing translational efficiency, (v) modifying localization of peptides or products expressed from nucleic acid reagents described herein, (vi) increasing or decreasing the copy number of a nucleotide sequence of interest, or (vii) expression of an anti-sense RNA, RNAi, siRNA, ribozyme and the like. In some embodiments, alteration of a nucleic acid reagent or nucleotide sequence can alter a region involved in feedback inhibition (e.g., 5' UTR, promoter and the like). A modification sometimes is made that can add or enhance binding of a feedback regulator and sometimes a modification is made that can reduce, inhibit or eliminate binding of a feedback regulator.

In certain embodiments, alteration of a nucleic acid reagent or nucleotide sequence can alter sequences involved in transcription initiation (e.g., promoters, 5' UTR, and the like). A modification sometimes can be made that can enhance or increase initiation from an endogenous or heterologous promoter element. A modification sometimes can be made that removes or disrupts sequences that increase or enhance transcription initiation, resulting in a decrease or elimination of transcription from an endogenous or heterologous promoter element.

In some embodiments, alteration of a nucleic acid reagent or nucleotide sequence can alter sequences involved in translational initiation or translational efficiency (e.g., 5' UTR, 3' UTR, codon triplets of higher or lower abundance, translational terminator sequences and the like, for example). A modification sometimes can be made that can increase or decrease translational initiation, modifying a ribosome binding site for example. A modification sometimes can be made that can increase or decrease translational efficiency. Removing or adding sequences that form hairpins and changing codon triplets to a more or less preferred codon are non-limiting examples of genetic modifications that can be made to alter translation initiation and translation efficiency.

In certain embodiments, alteration of a nucleic acid reagent or nucleotide sequence can alter sequences involved in localization of peptides, proteins or other desired products (e.g., an organic acid, for example). A modification sometimes can be made that can alter, add or remove sequences responsible for targeting a polypeptide, protein or product to an intracellular organelle, the periplasm, cellular membranes, or extracellularly. Transport of a heterologous product to a different intracellular space or extracellularly sometimes can reduce or eliminate the formation of inclusion bodies (e.g., insoluble aggregates of the desired product).

In some embodiments, alteration of a nucleic acid reagent or nucleotide sequence can alter sequences involved in increasing or decreasing the copy number of a nucleotide sequence of interest. A modification sometimes can be made that increases or decreases the number of copies of an ORF stably integrated into the genome of an organism or on an epigenetic nucleic acid reagent. Non-limiting examples of alterations that can increase the number of copies of a sequence of interest include, adding copies of the sequence of interest by duplication of regions in the genome (e.g., adding additional copies by recombination or by causing gene amplification of the host genome, for example), cloning additional copies of a sequence onto a nucleic acid reagent, or altering an ORI to increase the number of copies of an epigenetic nucleic acid reagent. Non-limiting examples of alterations that can decrease the number of copies of a sequence of interest include, removing copies of the sequence of interest by deletion or disruption of regions in the genome, removing additional copies of the sequence from epigenetic nucleic acid reagents, or altering an ORI to decrease the number of copies of an epigenetic nucleic acid reagent.

In certain embodiments, increasing or decreasing the expression of a nucleotide sequence of interest can also be accomplished by altering, adding or removing sequences involved in the expression of an anti-sense RNA, RNAi, siRNA, ribozyme and the like. The methods described herein can be used to modify expression of anti-sense RNA, RNAi, siRNA, ribozyme and the like.

Nucleic acid sequences of interest can be genetically modified using methods known in the art. Mutagenesis techniques are particularly useful for small scale (e.g., 1, 2, 5, 10 or more nucleotides) or large scale (e.g., 50, 100, 150, 200, 500, or more nucleotides) genetic modification. Mutagenesis allows the artisan to alter the genetic information of a cell or organism in a stable manner, either naturally (e.g., isolation using selection and screening) or experimentally by the use of chemicals, radiation or inaccurate DNA replication (e.g., PCR mutagenesis). In some embodiments, genetic modification can be performed by whole scale synthetic synthesis of nucleic acids, using a native nucleotide sequence as the reference sequence, and modifying nucleotides that can result in the desired alteration of activity. Mutagenesis methods sometimes are specific or targeted to specific regions or nucleotides (e.g., site-directed mutagenesis, PCR-based site-directed mutagenesis, and in vitro mutagenesis techniques such as transplacement and in vivo oligonucleotide site-directed mutagenesis, for example). Mutagenesis methods sometimes are non-specific or random with respect to the placement of genetic modifications (e.g., chemical mutagenesis, insertion element (e.g., insertion or transposon elements) and inaccurate PCR based methods, for example).

Site directed mutagenesis is a procedure in which a specific nucleotide or specific nucleotides in a nucleic acid molecule are mutated or altered. Site directed mutagenesis typically is performed using a nucleic acid sequence of interest cloned into a circular plasmid vector. Site-directed mutagenesis requires that the wild type sequence be known and used a platform for the genetic alteration. Site-directed mutagenesis sometimes is referred to as oligonucleotide-directed mutagenesis because the technique can be performed using oligonucleotides which have the desired genetic modification incorporated into the complement of a nucleotide sequence of interest. The wild type sequence and the altered nucleotide are allowed to hybridize and the hybridized nucleic acids are extended and replicated using a DNA polymerase. The double stranded nucleic acids are introduced into a host (e.g., E. coli, for example) and further rounds of replication are carried out in vivo. The transformed cells carrying the mutated nucleic acid sequence are then selected and/or screened for those cells carrying the correctly mutagenized sequence. Cassette mutagenesis and PCR-based site-directed mutagenesis are further modifications of the site-directed mutagenesis technique. Site-directed mutagenesis can also be performed in vivo (e.g., transplacement "pop-in pop-out", in vivo site-directed mutagenesis with synthetic oligonucleotides and the like, for example).

PCR-based mutagenesis can be performed using PCR with oligonucleotide primers that contain the desired mutation or mutations. The technique functions in a manner similar to standard site-directed mutagenesis, with the exception that a thermocycler and PCR conditions are used to replace replication and selection of the clones in a microorganism host. As PCR-based mutagenesis also uses a circular plasmid vector, the amplified fragment (e.g., linear nucleic acid molecule) containing the incorporated genetic modifications can be separated from the plasmid containing the template sequence after a sufficient number of rounds of thermocycler amplification, using standard electrophoretic procedures. A modification of this method uses linear amplification methods and a pair of mutagenic primers that amplify the entire plasmid. The procedure can take advantage of the E. coli Dam methylase system which causes DNA replicated in vivo to be sensitive to the restriction endonucleases Dpnl. PCR synthesized DNA is not methylated and is therefore resistant to Dpnl. This approach allows digestion of the template plasmid, leaving the genetically modified, PCR synthesized plasmids for isolating and transforming into a host bacteria for DNA repair and replication, thereby facilitating subsequent cloning and identification steps. A certain amount of randomness can be added to PCR-based sited directed mutagenesis by using partially degenerate primers.

DNA shuffling is a method which uses DNA fragments from members of a mutant library and reshuffles the fragments randomly to generate new mutant sequence combinations. The fragments are typically generated using DNasel, followed by random annealing and re-joining using self priming PCR. The DNA overhanging ends, from annealing of random fragments, provide "primer" sequences for the PCR process. Shuffling can be applied to libraries generated by any of the above mutagenesis methods.

Error prone PCR and its derivative rolling circle error prone PCR uses increased magnesium and manganese concentrations in conjunction with limiting amounts of one or two nucleotides to reduce the fidelity of the Taq polymerase. The error rate can be as high as 2% under appropriate conditions, when the resultant mutant sequence is compared to the wild type starting sequence. After amplification, the library of mutant coding sequences must be cloned into a suitable plasmid. Although point mutations are the most common types of mutation in error prone PCR, deletions and frameshift mutations are also possible. There are a number of commercial error-prone PCR kits available, including those from Agilent and Takara Bio, U.S.A. (e.g., World Wide Web Uniform Resource Locator (URL) agilent.com and World Wide Web Uniform Resource Locator (URL) clontech.com, respectively, for example). Rolling circle error-prone PCR is a variant of error-prone PCR in which wild-type sequence is first cloned into a plasmid, then the whole plasmid is amplified under error-prone conditions.

In contrast to site-directed or specific mutagenesis, random mutagenesis does not require any sequence information and can be accomplished by a number of widely different methods. Random mutagenesis often is used to generate mutant libraries that can be used to screen for the desired genotype or phenotype. Non-limiting examples of random mutagenesis include; chemical mutagenesis, UV-induced mutagenesis, insertion element or transposon-mediated mutagenesis, DNA shuffling, error-prone PCR mutagenesis, and the like.

Chemical mutagenesis often involves chemicals like ethyl methanesulfonate (EMS), nitrous acid, mitomycin C, N-methyl-N-nitrosourea (MNU), diepoxybutane (DEB), 1, 2, 7, 8-diepoxyoctane (DEO), methyl methane sulfonate (MMS), N-methyl-N'-nitro-N-nitrosoguanidine (MN NG), 4-nitroquinoline 1-oxide (4-NQO), 2-methyloxy-6-chloro-9 (3-[ethyl-2-chloroethyl]-aminopropylamino)-acridinedihydrochloride (ICR-170), 2-amino purine (2AP), and hydroxylamine (HA), provided herein as non-limiting examples. These chemicals can cause base-pair substitutions, frame-shift mutations, deletions, transversion mutations, transition mutations, incorrect replication, and the like. In some embodiments, the mutagenesis can be carried out in vivo. Sometimes the mutagenic process involves the use of the host organism's DNA replication and repair mechanisms to incorporate and replicate the mutagenized base or bases.

Another type of chemical mutagenesis involves the use of base-analogs. The use of base-analogs causes incorrect base pairing which in the following round of replication is corrected to a mismatched nucleotide when compared to the starting sequence. Base analog mutagenesis introduces a small amount of non-randomness to random mutagenesis, because specific base analogs can be chosen which can be incorporated at certain nucleotides in the starting sequence. Correction of the mispairing typically yields a known substitution. For example, bromo-deoxyuridine (BrdU) can be incorporated into DNA and replaces T in the sequence. The host DNA repair and replication machinery can sometime correct the defect, but sometimes will mispair the BrdU with a G. The next round of replication then causes a G-C transversion from the original A-T in the native sequence.

Ultra violet (UV) induced mutagenesis is caused by the formation of thymidine dimers when UV light irradiates chemical bonds between two adjacent thymine residues. Excision repair mechanism of the host organism correct the lesion in the DNA, but occasionally the lesion is incorrectly repaired typically resulting in a C to T transition.

In some embodiments, an altered activity can be found by screening cells or an organism under conditions that select for the desired change in activity. For example, certain microorganisms can be adapted to increase or decrease an activity by selecting or screening the organism in question on a media containing substances that are poorly metabolized or even toxic. An increase in the ability of an organism to grow a substance that is normally poorly metabolized may result in an increase in the growth rate on that substance, for example. A decrease in the sensitivity to a toxic substance might be manifested by growth on higher concentrations of the toxic substance, for example. Modifications obtained in this manner are not limited to alterations in promoter sequences. That is, screening microorganisms by selective pressure, as described above, can yield genetic alterations that can occur in non-promoter sequences, and sometimes also can occur in sequences that are not in the nucleotide sequence of interest, but in a related nucleotide sequences (e.g., a gene involved in a different step of the same pathway, a transport gene, and the like). Such mutants sometimes can be found by isolating variants from unique environments.

Cells or organisms with altered activities can also be isolated using genetic selection and screening of cells or organisms challenged on selective media or by identifying naturally occurring variants from unique environments. For example, 2-deoxy-D-glucose is a toxic glucose analog. Growth of yeast on this substance yields mutants that are glucose-deregulated. A number of mutants have been isolated using 2-deoxy-D-glucose including transport mutants, and mutants that ferment glucose and galactose simultaneously instead of glucose first then galactose when glucose is depleted. Similar techniques have been used to isolate mutant microorganisms that can metabolize plastics (e.g., from landfills), petrochemicals (e.g., from oil spills), and the like, either in a laboratory setting or from unique environments.

Similar methods can be used to isolate cells or organisms having existing mutations in a desired activity when the activity exists at a relatively low or nearly undetectable level in the cell or organism of choice, in some embodiments. The method generally consists of growing the cell or organism to a specific density in liquid culture, concentrating the cells, and plating the cells on various concentrations of the substance to which an increase in metabolic activity is desired. The cells are incubated at a moderate growth temperature, for 5 to 10 days. To enhance the selection process, the plates can be stored for another 5 to 10 days at a low temperature. The low temperature sometimes can allow strains that have gained or increased an activity to continue growing while other strains are inhibited for growth at the low temperature. Following the initial selection and secondary growth at low temperature, the plates can be replica plated on higher or lower concentrations of the selection substance to further select for the desired activity.

Insertion element or transposon-mediated mutagenesis makes use of naturally occurring or modified naturally occurring mobile genetic elements. Transposons often encode accessory activities in addition to the activities necessary for transposition (e.g., movement using a transposase activity, for example). In many examples, transposon accessory activities are antibiotic resistance markers (e.g., Tn903 kan$^r$). Insertion elements typically only encode the activities necessary for movement of the nucleic acid sequence. Insertion element and transposon mediated mutagenesis often can occur randomly, however specific target sequences are known for some transposons. Mobile genetic elements like IS elements or Transposons (Tn) often have inverted repeats, direct repeats or both inverted and direct repeats flanking the region coding for the transposition genes. Recombination events catalyzed by the transposase cause the element to remove itself from the genome and move to a new location, leaving behind a portion of an inverted or direct repeat. Classic examples of transposons are the "mobile genetic elements" discovered in maize. Transposon mutagenesis kits are commercially available which are designed to leave behind a 5 codon insert (e.g., Mutation Generation System kit, ThermoFisher Scientific, World Wide Web Uniform Resource Locator (URL) thermofisher.com/, for example). This allows the artisan to identify the insertion site, without fully disrupting the function of most genes.

Introduction of Nucleic Acids into Cells

Engineered cells and organisms can be prepared by altering, introducing and/or removing nucleotide sequences in the host genome or in stably maintained epigenetic nucleic acid reagents, as described herein. The nucleic acid reagents used to alter, introduce or remove nucleotide sequences in the host genome or epigenetic nucleic acids can be prepared using the methods described herein and/or available to the artisan.

Nucleic acid sequences having a desired activity can be isolated from cells of a suitable organism using lysis and nucleic acid purification procedures described in a known reference manual (e.g., Maniatis, T., E. F. Fritsch and J. Sambrook (1982) *Molecular Cloning: a Laboratory Manual*; Cold Spring Harbor Laboratory, Cold Spring Harbor, N.Y.) or using commercially available cell lysis and DNA purification reagents and kits. In some embodiments, nucleic acids used to engineer cells or microorganisms can be provided for conducting methods described herein after processing of the organism containing the nucleic acid. For example, the nucleic acid of interest may be extracted, isolated, purified or amplified from a sample (e.g., from a cell(s) or organism of interest or culture containing a plurality of cells or organisms of interest, like yeast or bacteria for example). The term "isolated" as used herein refers to nucleic acid removed from its original environment (e.g., the natural environment if it is naturally occurring, or a host cell if expressed exogenously), and thus is altered "by the hand of man" from its original environment. An isolated nucleic acid generally is provided with fewer non-nucleic acid components (e.g., protein, lipid) than the amount of components present in a source sample. A composition containing isolated sample nucleic acid can be substantially isolated (e.g., about 90%, 91%, 92%, 93%, 94%, 95%, 96%, 97%, 98%, 99% or greater than 99% free of non-nucleic acid components). The term "purified" as used herein refers to sample nucleic acid provided that contains fewer nucleic acid species than in the sample source from which the sample nucleic acid is derived. A composition containing sample nucleic acid may be substantially purified (e.g., about 90%, 91%, 92%, 93%, 94%, 95%, 96%, 97%, 98%, 99% or greater than 99% free of other nucleic acid species). The term "amplified" as used herein refers to subjecting nucleic acid of a cell, organism or sample to a process that linearly or exponentially generates amplicon nucleic acids having the same or substantially the same nucleotide sequence as the nucleotide sequence of the nucleic acid in the sample, or portion thereof. As noted herein, the nucleic acids used to prepare nucleic acid reagents as described herein can be subjected to fragmentation or cleavage.

Amplification of nucleic acids is sometimes necessary when dealing with cells or organisms that are difficult to culture. Where amplification may be desired, any suitable amplification technique can be utilized. Non-limiting examples of methods for amplification of polynucleotides include, polymerase chain reaction (PCR); ligation amplification (or ligase chain reaction (LCR)); amplification methods based on the use of Q-beta replicase or template-dependent polymerase (see US Patent Publication Number US20050287592); helicase-dependent isothermal amplification (Vincent et al., "Helicase-dependent isothermal DNA amplification". EMBO reports 5 (8): 795-800 (2004)); strand displacement amplification (SDA); thermophilic SDA nucleic acid sequence based amplification (3SR or NASBA) and transcription-associated amplification (TAA). Non-limiting examples of PCR amplification methods include standard PCR, AFLP-PCR, Allele-specific PCR, Alu-PCR, Asymmetric PCR, Colony PCR, Hot start PCR, Inverse PCR (IPCR), In situ PCR (ISH), Intersequence-specific PCR (ISSR-PCR), Long PCR, Multiplex PCR, Nested PCR, Quantitative PCR, Reverse Transcriptase PCR (RT-PCR), Real Time PCR, Single cell PCR, Solid phase PCR, combinations thereof, and the like. Reagents and hardware for conducting PCR are commercially available.

Protocols for conducting the various type of PCR listed above are readily available to the artisan. PCR conditions can be dependent upon primer sequences, target abundance, and the desired amount of amplification, and therefore, one of skill in the art may choose from a number of PCR protocols available (see, e.g., U.S. Pat. Nos. 4,683,195 and 4,683,202; and PCR Protocols: A Guide to Methods and Applications, Innis et al., eds, 1990). PCR often is carried out as an automated process with a thermostable enzyme. In this process, the temperature of the reaction mixture is cycled through a denaturing region, a primer-annealing region, and an extension reaction region automatically. Machines specifically adapted for this purpose are commercially available. A non-limiting example of a PCR protocol that may be suitable for embodiments described herein is, treating the sample at 95° C. for 5 minutes; repeating forty-five cycles of 95° C. for 1 minute, 59° C. for 1 minute, 10 seconds, and 72° C. for 1 minute 30 seconds; and then treating the sample at 72° C. for 5 minutes. Multiple cycles frequently are performed using a commercially available thermal cycler. Suitable isothermal amplification processes known and selected by the person of ordinary skill in the art also may be applied, in certain embodiments. In some embodiments, nucleic acids encoding polypeptides with a desired activity can be isolated by amplifying the desired sequence from a cell or organism having the desired activity using oligonucleotides or primers designed based on sequences described herein.

Synthetic nucleic acids, e.g., codon-optimized sequences, can be generated using a variety of methods. For example, whole-scale synthetic chemistry can be used to generate an entire sequence. Other methods include use of chemically-generated oligonucleotides in amplification methods, e.g., recursive PCR, that build an entire nucleotide sequence (see, e.g., Prodromou and Pearl (1992) *Protein Engineering* 5(8): 827-829; Yehezkel et al. (2013) *Gene Synthesis: Methods and Protocols* in Methods in Molecular Biology 852:35-47, Jean Piccoud (ed.) Springer Science and Business Media LLC).

Amplified, isolated and/or purified nucleic acids can be cloned into the recombinant DNA vectors described herein or into suitable commercially available recombinant DNA vectors. Cloning of nucleic acid sequences of interest into recombinant DNA vectors can facilitate further manipulations of the nucleic acids for preparation of nucleic acid reagents, (e.g., alteration of nucleotide sequences by mutagenesis, homologous recombination, amplification and the like, for example). Standard cloning procedures (e.g., enzymatic digestion, ligation, and the like) are known (e.g., described in Maniatis, T., E. F. Fritsch and J. Sambrook (1982) *Molecular Cloning: a Laboratory Manual*; Cold Spring Harbor Laboratory, Cold Spring Harbor, N.Y.).

In some embodiments, nucleic acid sequences prepared by isolation or amplification can be used, without any further modification, to add an activity to a cell or microorganism and thereby create a genetically modified or engineered cell or microorganism. In certain embodiments, nucleic acid sequences prepared by isolation or amplification can be genetically modified to alter (e.g., increase or decrease, for example) a desired activity. In some embodiments, nucleic acids, used to add an activity or composition to a cell or organism, sometimes are genetically modified to optimize the heterologous polynucleotide sequence encoding the desired activity (e.g., polypeptide or protein, for example). The term "optimize" as used herein can refer to alteration to increase or enhance expression by preferred codon usage. The term optimize can also refer to modifications to the amino acid sequence to increase the activity of a polypeptide or protein, such that the activity exhibits a higher catalytic activity as compared to the "natural" version of the polypeptide or protein.

A heterologous, recombinant, or mutagenized polynucleotide can be introduced into a nucleic acid reagent for introduction into a host cell or organism, thereby generating an engineered cell or microorganism. Standard recombinant DNA techniques (restriction enzyme digests, ligation, and the like) can be used by the artisan to combine a nucleic acid of interest into a suitable nucleic acid reagent capable of (i) being stably maintained by selection in the host cell or organism, or (ii) being integrated into the genome of the host cell or organism. Sometimes nucleic acid reagents include two replication origins to allow manipulation of the same nucleic acid reagent in bacteria before final introduction of the final product into the host cell or organism (e.g., yeast or fungus for example). Standard molecular biology and recombinant DNA methods are known (e.g., described in Maniatis, T., E. F. Fritsch and J. Sambrook (1982) *Molecular Cloning: a Laboratory Manual*; Cold Spring Harbor Laboratory, Cold Spring Harbor, N.Y.).

Nucleic acid reagents can be introduced into cells or microorganisms using various techniques. Non-limiting examples of methods used to introduce heterologous nucleic acids into various cells or organisms include; transformation, transfection, transduction, electroporation, ultrasound-mediated transformation, particle bombardment and the like. In some instances the addition of carrier molecules (e.g., bis-benzimdazolyl compounds, for example, see U.S. Pat. No. 5,595,899) can increase the uptake of DNA in cells that may be difficult to transform by conventional methods. Conventional methods of transformation are known (e.g., described in Maniatis, T., E. F. Fritsch and J. Sambrook (1982) *Molecular Cloning: a Laboratory Manual*; Cold Spring Harbor Laboratory, Cold Spring Harbor, N.Y.).

Figure 1:
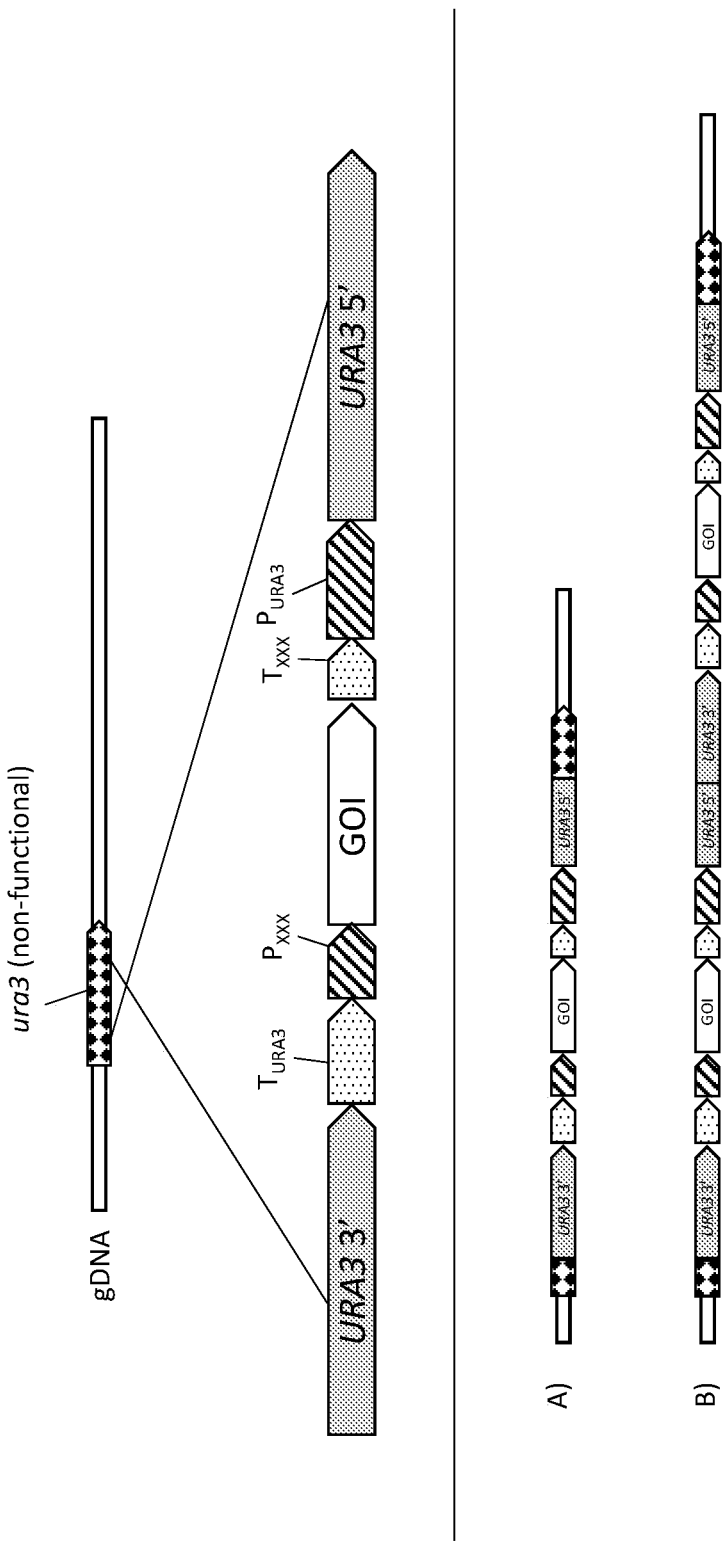
FIG. 1 is a diagrammatic representation of a cassette for the addition of a gene of interest (GOI) into a host non-functional ura3 locus using the single crossover integration method. The core of the cassette contains the GOI gene with a promoter ($P_{XXX}$) and terminator ($T_{XXX}$) for controlling transcription of the GOI gene. The URA3 gene selectable marker is split with a 3' portion of the gene at one end of the cassette and a 5' portion positioned at the other end of the cassette. The segment of the expression cassette containing the gene of interest (GOI) is positioned between the URA3 promoter ($P_{URA3}$) and terminator ($T_{URA3}$). Parts (A) and (B) of FIG. 1 show results of integration of one copy (A) and two copies (B) of the cassette. Integration of one cassette generates an added, functional GOI expression unit and may or may not provide for expression of a functional Ura3p, depending on the nature of the ura3 locus and the location of the split in the URA3 selectable marker. Integration of two copies of the cassette generates a complete, functional URA3 sequence by combining the 5' end of URA3 from one copy of the cassette and the 3' end of URA3 from the second copy of the cassette. Additional copies may also be integrated. Transformants are selected for by growth on uracil-free media. This integration method thus favors selection of transformants containing multiple copies of the GOI.

Linear DNA transformed into a host cell can be integrated into the genome by homologous recombination. The localization of genomic integration is determined by the homologous sequence at the ends of the transformed linear DNA. FIG. 1 is a diagrammatic representation of a cassette for the addition of a gene of interest (GOI) into a host non-functional ura3 locus using the single crossover integration method. The core of the cassette contains the GOI gene with a promoter ($P_{xxx}$) and terminator ($T_{xxx}$) for controlling transcription of the GOI gene. These DNA cassettes are typically generated by overlap extension PCR assembly of the cassette elements or by PCR amplification from circular plasmids containing the entire cassette. Additionally, circular plasmids containing cassette elements may be cut within (e.g., the middle of) the URA3 ORF to generate a linear DNA fragment used in transforming cells. A circular DNA vector containing the cassette core and an intact URA3 gene can be linearized by endonuclease-mediated cutting the vector such that it splits the URA3 selectable marker within (e.g., the middle of) the ORF. The resulting linear DNA contains the expression cassette of the gene of interest (GOI)

positioned between the URA3 promoter ($P_{URA3}$) and terminator ($T_{URA3}$). Parts A and B of FIG. 1 show the results of integration of one copy (A) and two copies (B) of the cassette into a Ura⁻ auxotrophic mutant strain. Integration of one cassette generates an added, functional GOI expression unit and may or may not provide for expression of a functional Ura3p, depending on the nature of ura3 locus and the location of the split in the URA3 selectable marker. Integration of two or more copies of the cassette in tandem arrays generates a complete, functional URA3 sequence by combining the 5' end of URA3 from one copy of the cassette and the 3' end of URA3 from the second copy of the cassette. Additional copies may also be integrated. Transformants can be selected by growth on uracil-free media. This integration method thus favors selection of transformants containing multiple copies of the GOI.

In some embodiments, other auxotrophic or dominant selection markers can be used in place of URA3 (e.g., an auxotrophic selectable marker), with the appropriate change in selection media and selection agents. Auxotrophic selectable markers are used in strains deficient for synthesis of a required biological molecule (e.g., amino acid or nucleoside, for example). Non-limiting examples of additional auxotrophic markers include; HIS3, TRP1, LEU2, LEU2-d, and LYS2. Certain auxotrophic markers (e.g., URA3 and LYS2) allow counter selection to select for the second recombination event that pops out all but one of the direct repeats of the recombination construct. HIS3 encodes an activity involved in histidine synthesis. TRP1 encodes an activity involved in tryptophan synthesis. LEU2 encodes an activity involved in leucine synthesis. LEU2-d is a low expression version of LEU2 that selects for increased copy number (e.g., gene or plasmid copy number, for example) to allow survival on minimal media without leucine. LYS2 encodes an activity involved in lysine synthesis, and allows counter selection for recombination out of the LYS2 gene using alpha-aminoadipate (α-aminoadipate).

Dominant selectable markers are useful because they also allow use of industrial and/or prototrophic strains for genetic manipulations. Additionally, dominant selectable markers provide the advantage that rich medium can be used for plating and culture growth, and thus growth rates are markedly increased. Non-limiting examples of dominant selectable markers include; Tn903 kan$^r$, Cm$^r$, Hyg$^r$, CUP1, and DHFR. Tn903 kan$^r$ encodes an activity involved in kanamycin antibiotic resistance (e.g., typically neomycin phosphotransferase II or NPTII, for example). Cm$^r$ encodes an activity involved in chloramphenicol antibiotic resistance (e.g., typically chloramphenicol acetyl transferase, for example). Hyg$^r$ encodes an activity involved in hygromycin resistance by phosphorylation of hygromycin B (e.g., hygromycin phosphotransferase, or HPT). CUP1 encodes an activity involved in resistance to heavy metal (e.g., copper, for example) toxicity. DHFR encodes a dihydrofolate reductase activity which confers resistance to methotrexate and sulfanilamde compounds.

Homologous recombination can also be used as a tool for mutagenesis. Homologous recombination can be used to specifically target regions of known sequence for insertion of heterologous nucleotide sequences using the host cell's natural DNA replication and repair enzymes. Homologous recombination methods sometimes are referred to as mutagenesis, transplacement, knock-out mutagenesis or knock-in mutagenesis. Integration of a nucleic acid sequence into a host genome by a double crossover homologous recombination event inserts the entire nucleic acid reagent at the targeted location. A second homologous recombination event driven by direct repeat DNA sequences contained in the integrated nucleic acid cassette excises (e.g., "pop out" or "loop out") all but a portion of the nucleic acid reagent, leaving behind a heterologous sequence, often referred to as a "footprint" or "scar". Mutagenesis by insertion (e.g., knock in) or by leaving behind a disrupting heterologous nucleic acid (e.g., knock out) serves to disrupt or "knock out" the function of the gene or nucleic acid sequence in which insertion occurs. By combining selectable markers and/or auxotrophic markers with nucleic acid reagents designed to provide the appropriate nucleic acid target sequences, the artisan can target a selectable nucleic acid reagent to a specific genomic region, and then select for recombination events that "pop out" a portion of the inserted nucleic acid reagent.

Such methods take advantage of nucleic acid reagents that have been specifically designed with known target nucleic acid sequences at or near a nucleic acid or genomic region of interest. Popping out typically leaves a "foot print" of left over sequences that remain after the recombination event. The left over sequence can disrupt a gene and thereby reduce or eliminate expression of that gene. In some embodiments, the method can be used to insert sequences, upstream or downstream of genes that can result in an enhancement or reduction in expression of the gene. In certain embodiments, new genes can be introduced into the genome of a host cell or organism using similar homologous recombination methods. An example of a yeast recombination system using the URA3 gene and 5-FOA is described herein.

One method for genetic modification is described by Alani et al. ("A method for gene disruption that allows repeated use of URA3 selection in the construction of multiply disrupted yeast strains", *Genetics* 116(4):541-545 August 1987). The original method uses a URA3 gene cassette with 1000 base pairs (bp) of the same nucleotide sequence cloned in the same orientation on either side of the URA3 cassette. Targeting sequences of about 50 bp are added to each side of the construct. The double-stranded targeting sequences are complementary to sequences in the genome of the host cell or organism. The targeting sequences allow site-specific recombination in a region of interest. A modification of the original technique replaces the two 1000 bp sequence direct repeats with two 200 bp direct repeats. The modified method also uses 50 bp targeting sequences. The modification reduces or eliminates recombination of a second knock out into the 1000 bp repeat left behind in a first mutagenesis, therefore allowing multiply knocked out yeast. Additionally, the 200 bp sequences used in the method are uniquely designed, self-assembling sequences that leave behind identifiable footprints. The technique used to design the sequences incorporate design features such as low identity to the yeast genome, and low identity to each other. Therefore, a library of the self-assembling sequences can be generated to allow multiple knockouts in the same organism, while reducing or eliminating the potential for integration into a previous knockout.

Figure 2:
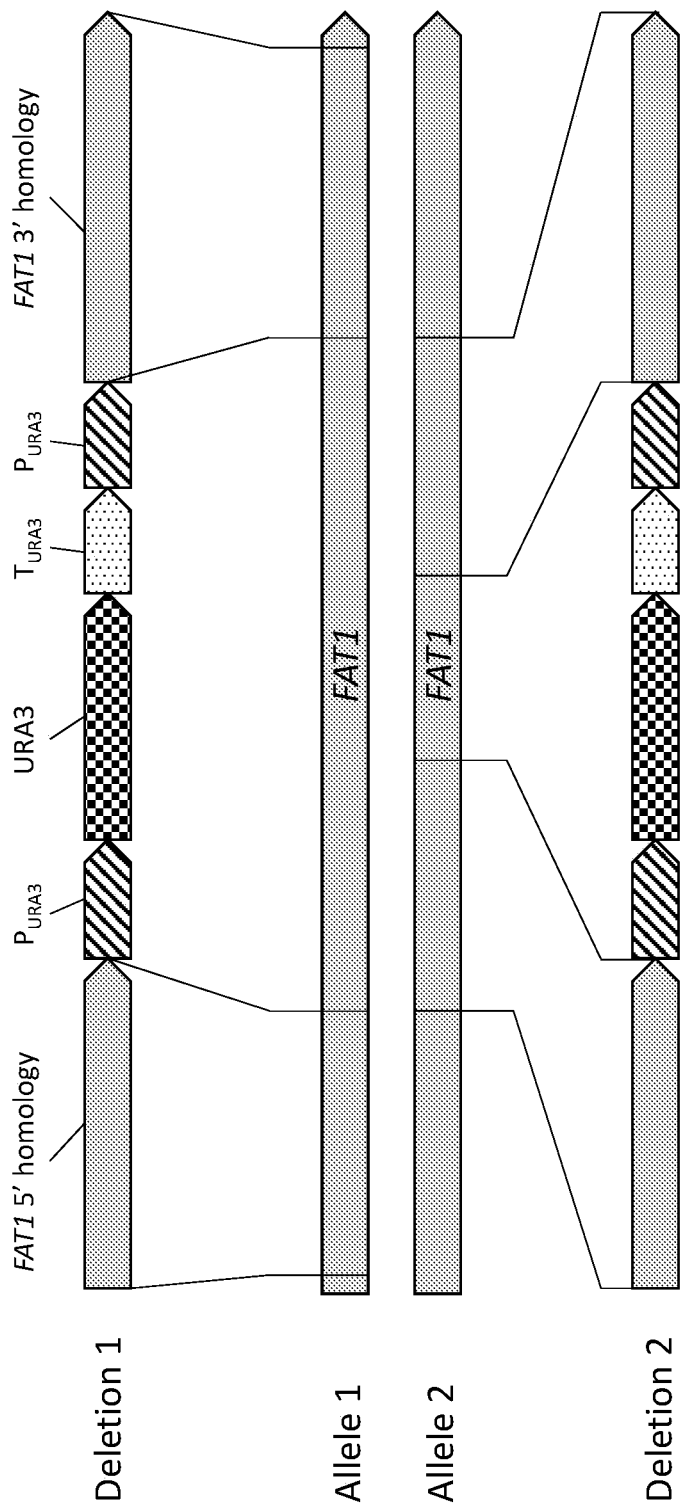
FIG. 2 is a diagrammatic illustration of an exemplary gene cassette for use in a double crossover homologous recombination integration referred to as "knock out" mutagenesis. Two slightly different cassettes are depicted for use in separately disrupting each of the two FAT1 alleles in a diploid yeast. The two cassette-containing nucleic acid segments are referred to as "Deletion 1" and "Deletion 2," respectively. Each cassette contains a URA3 gene including a URA3 promoter ($P_{URA3}$) and terminator ($T_{URA3}$). Additionally, each cassette contains a repeat of the $P_{URA3}$ sequence immediately downstream of the terminator sequence. The two separate deletion cassette-containing fragments differ in the sequences of the target gene that they contain on each side of the URA3 cassette.

FIG. 2 is a diagrammatic illustration of an exemplary gene knock out cassette. In this example, two slightly different cassettes are shown for use in separately disrupting each of the two FAT1 alleles in a diploid yeast such as *Candida viswanathii*. The two cassette-containing nucleic acid segments are referred to as "Deletion 1" and "Deletion 2," respectively, in the figure. Each cassette contains a URA3 gene including a URA3 promoter ($P_{URA3}$) and terminator ($T_{URA3}$). The complete URA3 expression cassette provides for expression of orotidine-5'-monophosphate (OMP) dicarboxylase in a Ura⁻ host cell into which the cassette has integrated, and yields a prototrophic transformant that can be selected for by growth in uracil-free media. Integration into the FAT1 locus by a first crossover event is provided for by the presence of sequences located on either side of the cassette that are homologous to sequences in the target locus (e.g., FAT1). Additionally, each cassette contains a repeat of the $P_{URA3}$ sequence immediately downstream of the terminator sequence. This repeat sequence can be used in a second recombination event that results in the looping out of the URA3 gene sequence which is facilitated by growth of the prototrophic transformants in the presence of 5-FOA yielding a ura⁻ auxotroph. All or a portion of the $P_{URA3}$ sequence repeat remains in the genome and disrupts the FAT1 gene allele such that it no longer yields a functional gene product. The heterozygous transformant can then be transformed with the second cassette (e.g., Deletion 2) and undergo the same two crossover events to yield a homozygous Ura⁻ cell. The two separate deletion cassette-containing fragments differ in the sequences of the target gene that they contain on each side of the URA3 cassette which results in integration into different positions in the target gene.

The URA3 cassette makes use of the toxicity of 5-FOA in yeast carrying a functional URA3 gene. Uracil synthesis-deficient host yeast are transformed with the modified URA3 cassette, using standard yeast transformation protocols, and the transformed cells are plated on minimal media minus uracil. In some embodiments, PCR can be used to verify correct insertion into the region of interest in the host genome, and in certain embodiments the PCR step can be omitted. Inclusion of the PCR step can reduce the number of transformants that are counter selected to "pop out" the URA3 cassette. The transformants (e.g., all or the ones determined as correct by PCR, for example) can then be counter-selected on media containing 5-FOA, which will select for recombination events looping out the URA3 cassette, thus rendering the yeast Ura⁻ again, and resistant to 5-FOA toxicity. Targeting sequences used to direct recombination events to specific regions are presented herein. A modification of the method described above can be used to integrate genes into the chromosome in which, following recombination, a functional gene is left in the chromosome next to a, e.g., 200-bp, footprint. Such methods provide for addition of a desired nucleic acid into the host genome in combination with disruption of an endogenous nucleic acid.

Figures 3A, 3B, 3C:
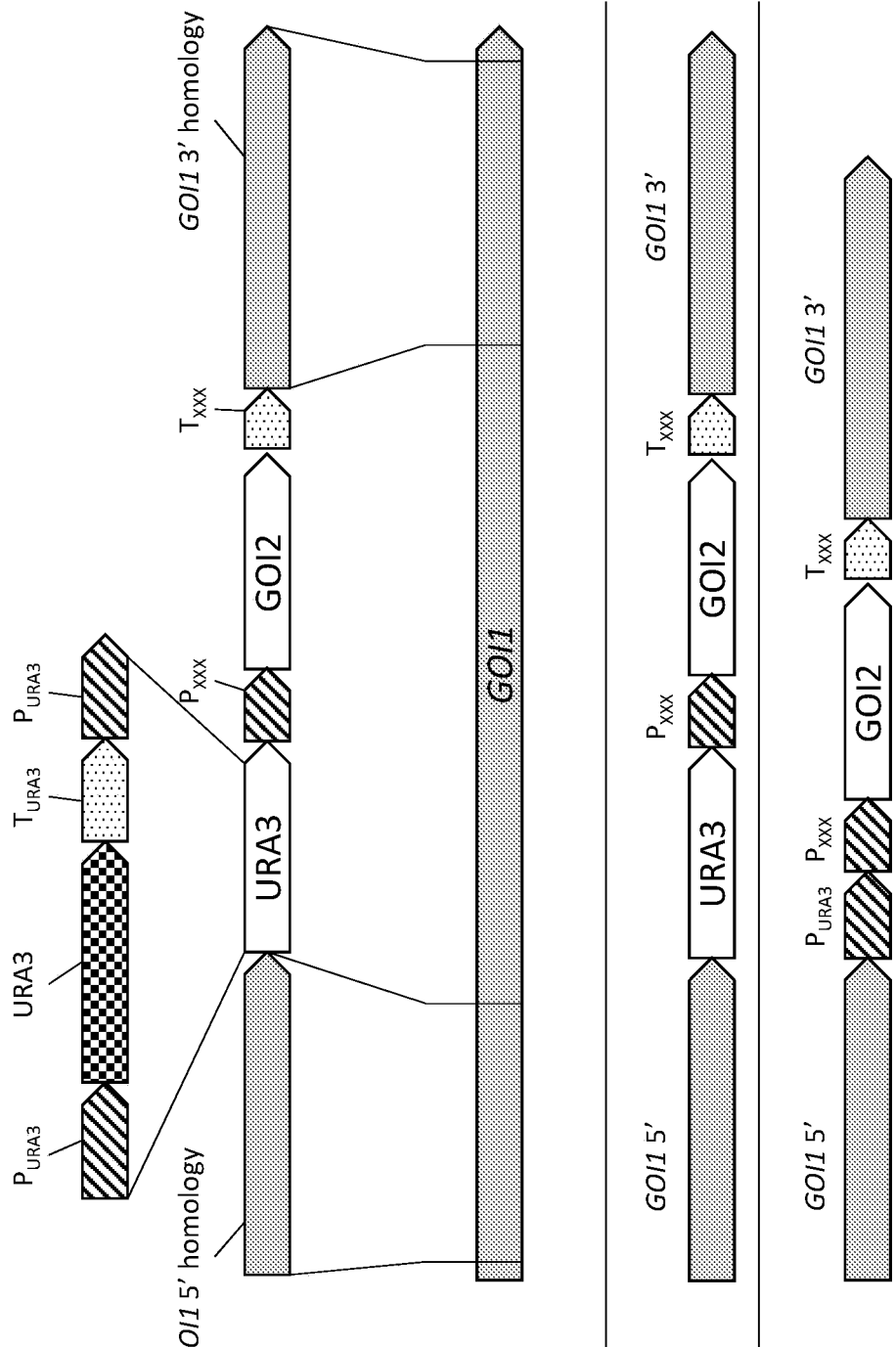
FIG. 3A, FIG. 3B, and FIG. 3C show diagrammatic illustrations of a "knock in" gene disruption method which disrupts one target gene ("GOI1") and also adds a desired gene of interest ("GOI2") at the disrupted locus. The basic URA3 disruption cassette is the same as that described in FIG. 2, except for an additional expression cassette immediately downstream of the second $P_{URA3}$ repeat sequence. This expression cassette contains the gene of interest, GOI2, for adding to the endogenous GOI1 locus and includes a promoter ($P_{XXX}$) and terminator ($T_{XXX}$) for controlling transcription of GOI2. Immediately upstream of the first $P_{URA3}$ sequence is a sequence of nucleotides of the GOI1 gene, and immediately downstream of the terminator ($T_{XXX}$) for GOI2 is another sequence of the GOI1 gene. These sequences are for use in integration of the cassettes into the GOI1 locus.

FIG. 3A, FIG. 3B, and FIG. 3C show diagrammatic illustrations of a knock-in gene disruption method which disrupts one target gene ("GOI1") and also adds a desired gene of interest ("GOI2") at the disrupted locus. As shown in FIG. 3A, the basic URA3 disruption cassette can be the same as that described in FIG. 2; however, there is an additional expression cassette immediately downstream of the second $P_{URA3}$ repeat sequence. This expression cassette contains the gene of interest, GOI2, for adding to the endogenous GOI1 locus and includes a promoter ($P_{XXX}$) and terminator ($T_{XXX}$) for controlling transcription of GOI2. Immediately upstream of the first $P_{URA3}$ sequence is a sequence of nucleotides of the GOI1 gene, and immediately downstream of the terminator ($T_{xxx}$) for GOI2 is another sequence of the GOI1 gene. These sequences are for use in integration of the cassettes into the GOI1 locus. FIG. 3B shows the locus after the first crossover event. These transformants are selected for growth in uracil-free media. In order to remove the URA3 gene and regenerate the auxotrophic cell that can be further modified using the URA3 marker method, the transformants are grown in the presence of 5-FOA to facilitate the second crossover event. The result of that event is shown in FIG. 3C which depicts the $P_{URA3}$ sequence that remains followed by a functional GOI2 cassette.

Protein Engineering Methods

As described herein, one method of altering carbon flux in cells and organisms is to modify one or more activities involved in carbon processing in cells. These activities can be modified by altering one or more elements directly and/or indirectly involved in the activities. Such elements include, but are not limited to, nucleic acids (e.g., transcription regulatory elements, addition and/or deletion of nucleic acids), peptides (e.g., signal peptides regulating protein localization in cells) and polypeptides (e.g., enzymes regulating reactions in metabolic pathways). Peptides and polypeptides can be modified in multiple ways, including, for example, alteration of the primary structure (i.e., amino acid sequence), secondary structure, post-translational chemical modification (e.g., phosphorylation, acylation, glycosylation) and processing (e.g., proteolytic cleavage). Many protein modifications can be achieved through alteration of the nucleic acid encoding the protein in a cell. Alteration of the nucleic acid coding sequence can result in alteration of the amino acid sequence which in turn can modify the intra- and inter-polypeptide interactions of the encoded protein. Such alterations can thus result in modification of the activity of the polypeptide and the activity of any metabolic processes in which it may participate.

In some embodiments of the cells, organisms, compositions and methods provided herein, a modified polypeptide can be expressed in a cell or organism by introducing a modification into nucleic acid encoding the polypeptide in the cell or organism. Modified polypeptides often have an activity different than the activity of an unmodified counterpart. A modified activity sometimes is a different transport activity, a different catalytic activity, a different substrate specificity, or a different catalytic activity and a different substrate specificity. A different activity sometimes is an activity that is higher (e.g., increased activity) or lower (e.g., decreased activity) than the activity of an unmodified counterpart polypeptide. In some embodiments, the catalytic activity of a modified polypeptide is higher or lower than the catalytic activity of the unmodified counterpart for a particular substrate. In certain embodiments, the specificity of a modified polypeptide for a particular substrate is higher or lower than the specificity of the unmodified counterpart for a particular substrate. A modified polypeptide often is active and an activity of a modified polypeptide often can be detected (e.g., substrate turnover can be detected). An activity for a particular polypeptide that is modified sometimes is referred to as a "target activity." As described herein, target activities include, but are not limited to, activities of ω-oxidation, β-oxidation, acetyl-CoA processing, carnitine/acetylcarnitine shuttle, membrane transport, fatty acid biosynthesis, acyl-CoA formation/degradation. Non-limiting examples of particular target activities include carnitine acetyltransferase, carnitine translocase, acetyl-CoA carboxylase, ATP citrate lyase, acetyl-CoA hydrolase, acetyl-CoA synthetase, thioesterase, acyl-CoA synthetase, monooxygenase, cytochrome P450 reductase, alcohol dehydrogenase, alcohol oxidase, aldehyde dehydrogenase, acyl-CoA oxidase, 3-ketoacyl-CoA thiolase, peroxisomal transporter, peroxisome biogenesis factor and multifunctional enzyme (e.g., enoyl-CoA hydratase and/or 3-hydroxyacyl-CoA dehydrogenase) activities. In some of the embodiments provided herein, these and other activities can be modified in a cell or organism.

One or more particular modifications can be selected to generate a modified polypeptide having a target activity. Modifications often are amino acid modifications (e.g., deletion, insertion of one or more amino acids). Amino acid modifications sometimes are amino acid substitutions. Amino acid substitutions sometimes are conservative, non-limiting examples of which include substitution of an amino acid containing an acidic moiety for another amino acid containing an acidic moiety (e.g., D, E), substitution of an amino acid containing a basic moiety for another amino acid containing a basic moiety (e.g., H, K, R), substitution of an amino acid containing an aliphatic chain moiety for another amino acid containing an aliphatic chain moiety (e.g., V, L, I, A), substitution of an amino acid containing a cyclic moiety for another amino acid containing a cyclic moiety (e.g., W, F, Y), and substitution of an amino acid containing a polar moiety for another amino acid containing a polar moiety (e.g., S, T). Amino acid substitutions sometimes are non-conservative, non-limiting examples of which include substitution of an amino acid containing an acidic moiety for an amino acid containing a basic moiety, substitution of an amino acid containing a basic moiety for an amino acid containing an acidic moiety, substitution of an amino acid containing relatively small moiety (e.g., G, A) for another amino acid containing a relatively large moiety (e.g., Y, W, F, I, L), and substitution of an amino acid containing a relatively large moiety for another amino acid containing an relatively small moiety.

Particular modifications can be selected using any suitable method known in the art. In certain embodiments, a reference structure is known for a related polypeptide with a known activity, and modifications to a target polypeptide can be guided by alignment of the target polypeptide structure to the reference structure. A reference structure sometimes is a primary structure (e.g., polynucleotide or polypeptide sequence) and the primary structure of a target can be aligned to the reference structure using an alignment method known in the art. Particular amino acids in the target that align with (e.g., are identical to or homologous to) or do not align with (e.g., are not identical to or not homologous to) particular amino acids in the reference can be selected for modification. Selections can be made by inspection of an alignment or by software known in the art that identifies, scores and/or ranks amino acids for modification based on an alignment. A reference structure sometimes is a secondary structure, tertiary structure or quaternary structure, each of which are three dimensional structures pertaining to a polypeptide. A primary structure of a target polypeptide can be modeled to a secondary, tertiary or quaternary reference structure using three-dimensional modeling software known in the art. A secondary, tertiary or quaternary structure of a target polypeptide can be compared to a secondary, tertiary or quaternary reference structure using three-dimensional comparative software known in the art. Particular structures (e.g., a particular individual amino acid; a particular group of contiguous or non-contiguous amino acids) in the target that align with or map to, or do not align with or map to, particular structures in the reference can be selected for modification. Also, particular structures in the target that are in proximity to a substrate or co-factor can be selected for modification. Selections can be made by inspection of an alignment or map or by software known in the art that identifies, scores and/or ranks amino acids and/or structures for modification based on an alignment and map. After particular amino acids and/or structures are selected for modification in a first polypeptide, amino acids and structures in a second polypeptide that align with the selected amino acids and structures in the first polypeptide may be identified.

For example, a structural model of a protein can be created based on the crystal structure of the protein using SWISS-MODEL, which has been described by Arnold et al. ((2006) *Bioinformatics* 22: 195-201), Guex et al. ((2009) *Electrophoresis* 30 Supplement 1: S162-S173) and Kiefer et al. ((2009) *Nucleic Acids Res.* 37 (Database issue): D387-D392). As described herein, the resulting structural model can be analyzed to identify sites in the protein that potentially participate in determining an activity of the protein. HotSpot Wizard is an example of a tool for identifying sites for engineering of substrate specificity and/or activity of enzymes using a combination of structural, functional and sequence analysis and has been described by Pavelka et al. ((2009) *Nucleic Acids Res.* 37 (Web Server issue): W376-W383) (see also: HotSpot Wizard 1.7 World Wide Web Uniform Resource Locator (URL) loschmidt.chemi.muni.cz/hotspotwizard/index.jsp). Identification of such sites facilitates a determination of possible amino acids to target for mutagenesis in modifying the activity of a protein (e.g., enzyme). Part of the HotSpot Wizard analysis is the identification of homologs by a BLAST search (see, e.g., Johnson et al. (2008) *Nucleic Acids Res.* 36 (Web Server issue): W5-W9) and their alignment using MUSCLE as described, for example, by Edgar ((2004) *BMC Bioinformatics* 5: 113 and *Nucleic Acids Res.* 32: 1792-1797). The multiple sequence alignment reveals the variety of amino acids found at each position and their relative frequency amongst all the sequences. This information can be useful in determining possible amino acid substitutions that may be made at identified sites in the protein.

In a non-limiting example, particular amino acid substitutions for a *Candida* spp. Pox5 acyl-CoA oxidase polypeptide are provided herein. For example, some substitutions were designed to modify a substrate specificity of an acyl-CoA oxidase polypeptide. As described herein, in embodiments in which the target product molecule is a six-carbon fatty acid (e.g., adipic acid) produced by β-oxidation of a longer-chain fatty acid, it is optimal to modify the activity of acyl-CoA oxidases (which can catalyze the first step in β-oxidation) in host cells or organisms such that there is little to no activity on substrates with chain lengths less than 8 carbons. Deletion of nucleic acids encoding acyl-CoA oxidases (e.g., Pox4 in *Candida viswanathii*) with relatively broad carbon-chain length specificity that are active on short-chain length substrates prevents generation of fatty acid products with fewer than eight carbon atoms (i.e., chain length shorter than C8) by peroxisomal β-oxidation. This is because the remaining acyl-CoA oxidase activity (e.g., Pox5) is specific for longer chain substrates and has low activity on substrates with carbon chain lengths less than 10. In order to increase the activity of Pox5 on substrates with a chain length of 8 carbons and thereby increase the amount of 6-carbon fatty acid target molecule products relative to 8-carbon fatty acid molecules, the Pox5 protein was subjected to engineering as described herein. Modified Pox5 proteins obtained by amino acid substitutions of the wild-type *Candida viswanathii* Pox5 protein (made via corresponding nucleotide sequence changes in the nucleic acid encoding the protein) resulted in an increased ratio of 6-carbon to 8-carbon fatty acid products in *Candida* cells expressing the modified enzymes as compared to cells expressing wild-type Pox5p (as shown by experimental results presented in the Examples herein). Using the teachings described herein, a primary structure of another acyl- CoA oxidase polypeptide can be aligned with the amino acid sequence or modeled structure of a Pox5 polypeptide and some or all amino acids of the other polypeptide that align with those selected for modification in the Pox5 polypeptide also can be selected for modification.

Additional nonlimiting examples of protein modifications that can be made in altering the carbon flux in a cell or organism include modifications to alter a substrate specificity of an acyl-CoA dehydrogenase polypeptide produced in the cell and that is involved in β-oxidation. An acyl-CoA dehydrogenase enzyme can require an NAD cofactor in carrying out a catalytic function. Sometimes a co-factor specificity of an acyl-CoA dehydrogenase is modified, and in some embodiments the modified polypeptide prefers to utilize oxygen as a co-factor.

In another non-limiting example of a protein modification designed to modify an enzyme activity, amino acid substitutions can be made to enhance or reduce regulation of the enzyme. For example, enzymes can be regulated in a number of ways, including, for example, covalent modification of an enzyme such as phosphorylation/dephosphorylation and acetylation/deacetylation. The activity of an enzyme can be modified by altering its ability to be activated or inhibited within a cell. In one embodiment, regulation of an enzyme by phosphorylation can be decreased or eliminated by modifying a nucleic acid encoding the enzyme to substitute codons for phosphorylatable amino acid residues (e.g., serine) with codons for non-phosphorylatable residues (e.g, alanine). Computer-assisted software programs are available for identifying potential phosphorylatable amino acid residues (see, e.g., NetPhos (World Wide Web Uniform Resource Locator (URL) cbs.dtu.dk/services/NetPhos/), NetPhosYeast (World Wide Web Uniform Resource Locator (URL) cbs.dtu.dk/services/NetPhosYeast/)). In an example described herein, an acetyl-CoA carboxylase protein (e.g., Acc1 of *Candida viswanathii*) is modified to reduce regulation of the enzyme by phosphorylation. Because the dephosphorylated state is the active state of the enzyme, the protein (and nucleic acid encoding it) was modified to eliminate one or more phosphorylatable serine residues by substituting them with alanine residues, thereby relieving the regulation by phosphorylation. For example, as described herein, a *Candida viswanathii* acetyl-CoA carboxylase endogenous, wild-type enzyme was modified to substitute alanine residues for one or more of the following serine amino acid residues: S652, S1131, S1138, S1153, S1158.

One or more activities of a modified polypeptide can be characterized using any suitable assay known in the art. A modified polypeptide can be expressed in a cell or organism other than a target organism in which a target product will be produced, for assaying activity. For example, a modified polypeptide can be expressed in a bacterium (e.g., *E. coli*), assayed and then introduced into a yeast (e.g., *Candida* spp. yeast) for production of a target molecule product.

Engineered Carbon Flux Pathways for Efficient Production of Target Molecules

Provided herein are multiple compositions for, and methods of, modifying cells and organisms to alter carbon flux. Also provided are the modified cells and organisms generated by the methods. The modification methods can be combined in a number of ways as described herein to engineer cell- or organism-based systems for enhanced, efficient production of target molecules. Also provided herein are methods of producing target molecules, including, for example, organic acids, polyketides and terpenes, using the modified cells or organisms provided herein.

Included in the cells, organisms, compositions and methods provided herein are modified cells and organisms in which carbon processing activities have been engineered to enhance carbon flow through cellular oxidative metabolism pathways. One advantage of such modified bioproduction systems is that they are well suited for use with lower cost, alternative carbon sources, including, for example, non-carbohydrate and non-fermentable carbon sources such as aliphatic compounds and hydrocarbons (e.g, alkanes, fatty acids and fatty alcohols). Use of such carbon sources is not only more cost-effective but can also have the added advantage of reducing the environmental impact of harmful wastes (e.g., agro-industrial by-products, waste cooking oil and waste motor oil) that can be used as feedstocks in target molecule production instead of being discarded. As also described herein, embodiments of the cell- and microbial-based systems in which carbon processing activities have been engineered to direct carbon flow through oxidative metabolism can be controlled to provide for maximal, coordinated and highly efficient target molecule production based on, for example, use of carbon source-dependent transcription regulation.

FIGS. 5-11 schematically illustrate non-limiting embodiments of engineered carbon flux pathways of modified cells and organisms that can be used to produce a target molecule (e.g., adipic acid, malonyl-CoA, 3-hydroxypropionic acid, polyketide, triacetic acid lactone, terpene) from various starting carbon sources or feedstocks.

Engineered Carbon Recycling Loop Pathways for a Platform Target Molecule Production System In order to minimize carbon loss and increase process efficiency of biological cell-based production systems, provided herein are cells and organisms (e.g., microorganisms) that have been modified to reduce, inhibit, slow and/or delay carbon flow into one or more growth and/or energy production metabolic pathways so that it is available for use in other inherent and/or engineered production processes. In doing so, carbon that would be lost to metabolic pathways uninvolved in target molecule production in an unmodified cell or organism are rescued or captured for use in target molecule production processes. As such, modified cells and organisms provided herein in some embodiments are useful as platform systems (as well as production systems) that can be used as the basis for further engineering for enhanced production of many different desired target molecules either singly or multiply in co-production cell- and microbial-based systems.

Figure 5:
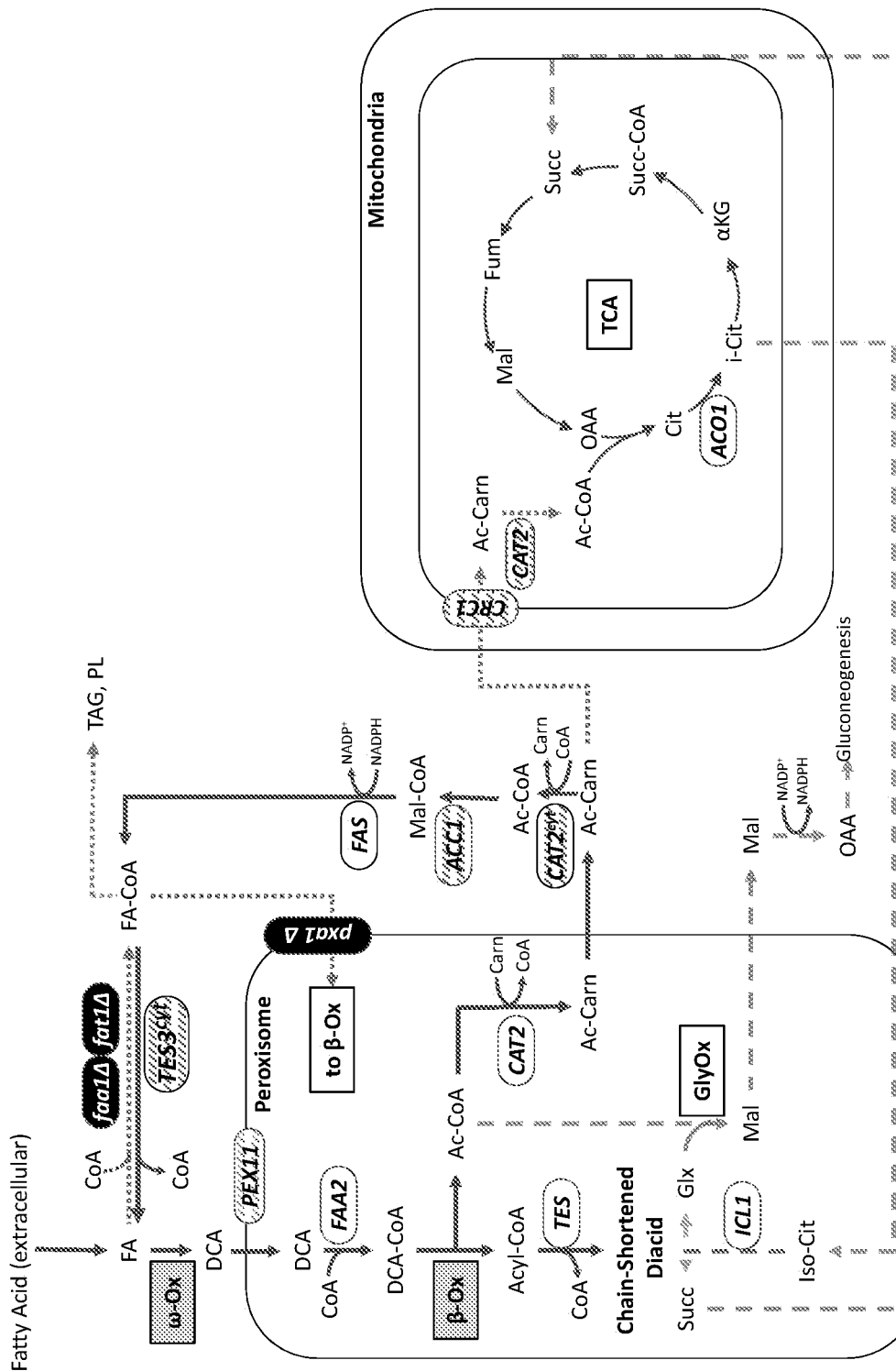
FIG. 5 is a schematic illustration of an engineered carbon flux pathway of a modified cell for use in producing a target molecule. The figure depicts cellular modifications in some embodiments of a eukaryotic (i.e., yeast in this example) platform system for developing particular target molecule production systems. The platform system contains an acetyl group carbon recycle loop that diverts acetyl moieties generated in the breakdown of fatty acids in peroxisomal β-oxidation ("β-ox") into cytosolic fatty acid synthesis to regenerate a fatty acid that can be subjected to another cycle of peroxisomal β-oxidation. The recycle loop is depicted by the dark, solid reaction arrows beginning with extracellular fatty acid ("FA") internalization in the upper left corner of the figure. Free fatty acids that have entered the cell can undergo oxidation to dicarboxylic acids (DCA) through ω-oxidation ("ω-ox"). Multiple modifications introduced via genetic manipulation, as well as unmodified activities of the cell, are indicated as follows: acyl-CoA synthetase gene deletions shown as "faa1Δ" and "fat1Δ" and resulting disruption of cytosolic activation of fatty acids (indicated as a lightly shaded dotted line reaction arrow below the gene deletion symbols and extending from "FA" to "FA-CoA") and diminished entry of FA-CoA into lipid (triacylglycerides ("TAG") and phospholipids ("PL")) biosynthesis; endogenous, unmodified peroxisomal enzymes acyl-CoA synthetase ("FAA2") and thioesterase ("TES"); unmodified glyoxylate cycle ("GlyOx") showing endogenous isocitrate lyase enzyme ("ICL1"); unmodified endogenous peroxisomal carnitine acetyltransferase ("CAT2") for conversion of acetyl-CoA ("Ac-CoA") to acetyl-carnitine ("AC-Cam"); modified (indicated by diagonal hatch lines) cytosolic carnitine acetyltransferase ("CAT2$^{cyto}$") and acetyl-CoA carboxylase ("ACC1") enzymes; unmodified endogenous fatty acid synthase enzyme complex ("FAS"); modified and added cytosolic thioesterase enzyme ("TES$^{cyto}$") showing added activity as solid, dark reaction arrow extending from FA-CoA to FA (which represents the final segment of the recycle loop); modified (gene deletion) peroxisomal transport protein ("pxa1Δ") showing disrupted (lightly shaded dotted line reaction arrow) acyl-CoA ("FA-CoA") import activity; modified peroxisomal biogenesis factor ("PEX11") activity; modified (promoter replacement) mitochondrial acetyl-carnitine transport protein ("CRC1") showing diminished (lightly shaded dotted line reaction arrow) acetyl-carnitine import activity; modified mitochondrial carnitine acetyltransferase ("CAT2") activity showing decreased conversion (lightly shaded dotted line reaction arrow) of AC-Carn to AC-CoA; unmodified mitochondrial tricarboxylic acid cycle ("TCA"); lightly shaded dashed lines reflect unmodified cellular activities that are not part of the carbon recycle loop shown in dark, solid lines. The details of the modifications in this exemplary engineered platform system are provided in the Detailed Description that follows.

Engineered Pathways for Capturing Carbon Atoms Expelled from the β-Oxidation Pathway FIGS. 5 and 6 depict possible cellular modifications in exemplary embodiments of a eukaryotic (i.e., yeast in this example) platform system designed to capture carbon atoms in the cytosol by enhancing carbon flow through cellular oxidative metabolism pathways (ω-oxidation and peroxisomal β-oxidation) and reducing flow of carbon into mitochondria, and the endoplasmic reticulum and lipid particles (in the form of acyl-CoA). Although multiple, possible, cellular modifications are illustrated in FIGS. 5 and 6, as described herein, some of the modifications depicted in the figures are optional enhancements of exemplary engineered systems and may or may not be included in a modified cell or organism depending on, for example, the intended use of the system (e.g., development of a particular single, or multiple, target molecule(s) production system) and the selection of variable features (e.g., host cell or organism, carbon source, regulatory controls (such as transcription control elements), culture conditions and the like) of the system. Thus, it is understood that any optional modifications set forth in the exemplary systems shown in FIGS. 5 and 6 are non-limiting and may or may not be included in a particular engineered system and, if included, may be in utilized in different combinations than illustrated in the figures.

Figure 4:
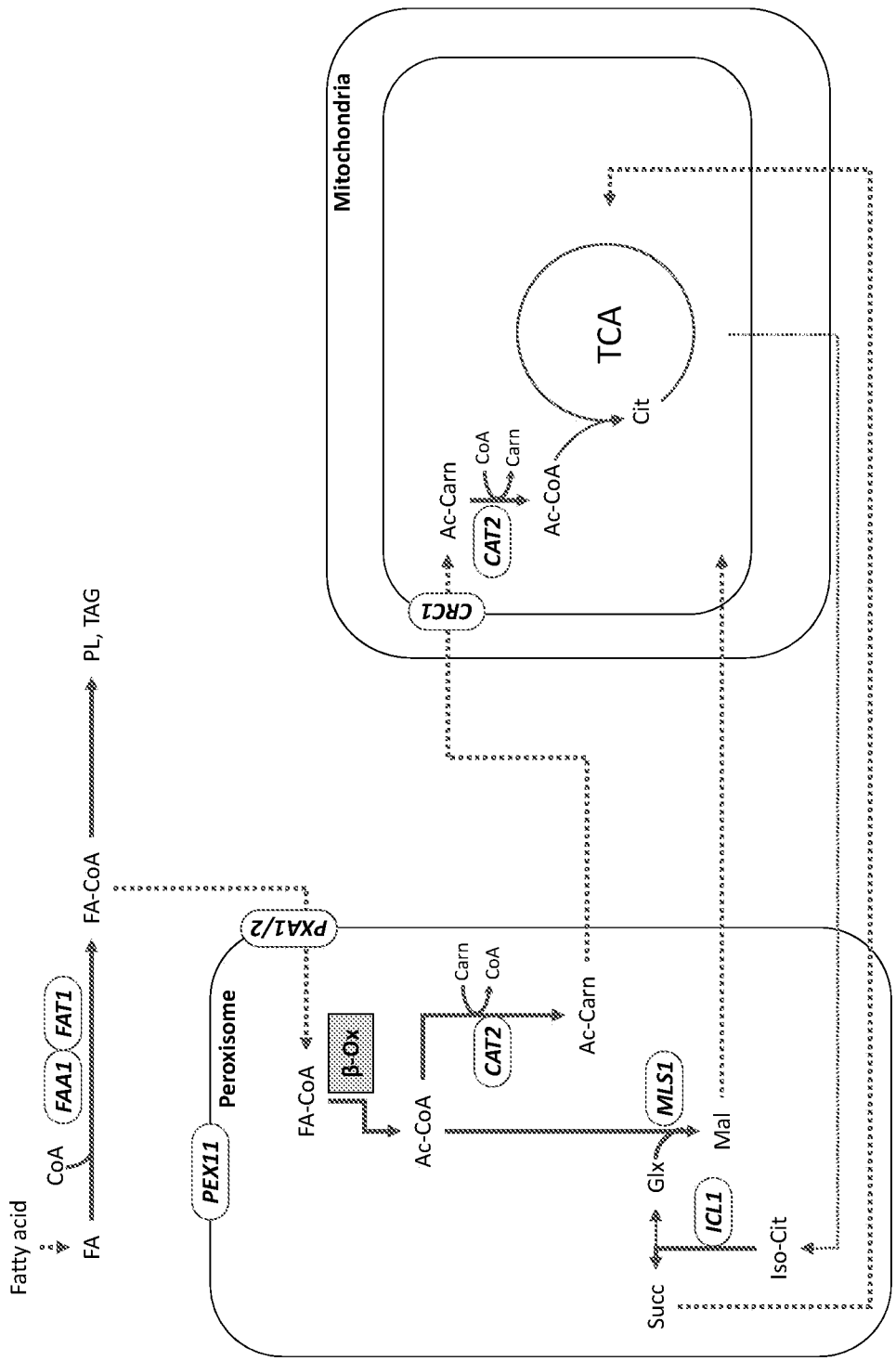
FIG. 4 is a schematic illustration of the general, unmodified flow of carbon from a fatty acid carbon source in a wild-type eukaryotic cell, such as, for example, a yeast cell. "FA": fatty acid; "Co-A": coenzyme A; "PL": phospholipid; "TAG": triacylglyceride; FA-CoA: fatty acyl-CoA "FAA1" and "FAT1": acyl-CoA synthetase genes; "PEX11": peroxisomal biogenesis factor gene; "PXA1": peroxisomal transport protein gene; "β-Ox": β-oxidation; "Ac-CoA": acetyl-CoA; "CAT2": carnitine acetyltransferase gene; "Cam": carnitine; "Ac-Carn": acetyl-carnitine; "CRC1": mitochondrial acetyl-carnitine transport protein; "Cit": citrate; "TCA": tricarboxylic acid cycle; "Iso-Cit": isocitrate; "ICL1": isocitrate lyase gene; "Succ": succinate; "MLS1": malate synthase gene; "Glx": glyoxylate; "Mal": malate.

Acetyl-CoA is a central molecule in the biochemical network of a cell that can be utilized for the biosynthesis of many useful chemicals. The β-oxidation pathway produces acetyl-CoA through the oxidation of fatty acids. In yeast, β-oxidation can be localized to the peroxisomal compartment which thus can be a primary location of fatty acid-derived acetyl-CoA. Generally, the peroxisomal acetyl-CoA would be converted to acetyl-carnitine by carnitine acetyl-transferase (Cat2p). The acetyl-carnitine, being smaller, can diffuse out of the peroxisome and be transported across the mitochondrial inner membrane by Crc1p (a translocase protein). Once inside the mitochondria, the acetyl-carnitine is converted back into acetyl-CoA by mitochondrial Cat2p and can be used in the TCA cycle for energy generation or the synthesis of other biomolecules (FIG. 4). To take advantage of the acetyl-CoA generated by peroxisomal β-oxidation, genetic engineering strategies may be employed to reroute the carbon in acetyl-CoA destined for the mitochondria to the cytosol instead, thereby making it available for use in biosynthetic pathways making desired chemical products. Thus, the amount of carbon that is lost to the TCA and lipid-generating (e.g., glycerol-3-phosphate (G3P) and/or dihydroxyacetone phosphate (DHAP)) pathways at the expense of target molecule production is reduced in this platform system. In embodiments of a platform system such as, for example, systems shown in FIGS. 5 and 6, carbon processing activities can be engineered to enhance carbon flow through cellular oxidative metabolism pathways, e.g., ω-oxidation and peroxisomal β-oxidation, and decrease carbon flow to mitochondria and other organelles. Such platform systems can include an acetyl group carbon recycle loop that diverts acetyl moieties generated in the breakdown of fatty acids in peroxisomal β-oxidation into cytosolic fatty acid synthesis to regenerate a fatty acid that can be subjected to another cycle of peroxisomal β-oxidation. The recycle loop is depicted in FIGS. 5 and 6 by the dark, solid reaction arrows beginning with extracellular fatty acid internalization in the upper left corner of the figure, extending through w-oxidation and into the peroxisome for β-oxidation which yields acetyl-CoA that is transported out of the peroxisome and into the cytosol (initially in the form of either acetyl-carnitine or acetate), utilized in fatty acid synthesis to generate acyl-CoA which is then hydrolyzed to free fatty acid for re-entry into the loop at the starting point of ω-oxidation.

As shown in FIGS. 5 and 6, carbon flux through the ω-oxidation and β-oxidation (peroxisomal) pathways can be enhanced through one or more of multiple modifications introduced via genetic manipulation of the cell. The enhancements can begin with the cellular internalization of external carbon. A non-fermentable or alternative carbon source (e.g., fatty acids, alkanes) enters the modified cell through the plasma membrane from the extracellular medium (shown in the upper left corner of FIGS. 5 and 6). In an unmodified cell, a long-chain fatty acid (either as the carbon source or generated from processing of a carbon source, e.g., alkane) would be activated (through thioester-ifcation with CoA) to acyl-CoA upon cell entry by acyl-CoA synthetase (encoded, e.g., by FAA1 and/or FAT1). However, in some embodiments, a gene(s) encoding cytosolic and/or membrane-bound acyl-CoA synthetase can be disrupted or deleted resulting in a decrease or elimination of cytosolic and/or membrane-bound acyl-CoA synthetase and, thus, cytosolic and/or membrane-bound acyl-CoA synthetase activity in the cytosol. Cytosolic activation of fatty acids can thus also be decreased or eliminated in such modified cells (indicated in FIGS. 5 and 6 as a lightly shaded dotted line reaction arrow labeled as "faa1Δ" and "fat1Δ" in blackened ovals). Most fatty acid metabolic pathways, including lipid (e.g, triacylglycerides (TAG) and phospholipids (PL)) biosynthesis and protein acylation, require that a free fatty acid be activated to acyl-CoA (or to acyl-ACP) prior to being metabolized. Therefore, in embodiments that include an enhancement such as a reduced or abolished acyl-CoA synthetase activity, the decreased cytosolic fatty acid activation can result in fewer internalized fatty acid carbons being lost to such pathways at the expense of target molecule-producing processes.

Free fatty acids that have entered the cell (shown as "FA" in FIGS. 5 and 6), or generated from metabolism of an alkane carbon source, can then undergo oxidation to dicarboxylic acids (DCA) through ω-oxidation ("ω-ox" in FIGS. 5 and 6). The availability of this oxidative process in the cell presents multiple advantages in these platform systems for target molecule production. For example, long-chain fatty acids that have not been activated to acyl-CoA do not readily cross the peroxisomal membrane; however, long-chain dicarboxylic acids are able to enter peroxisomes. Therefore, conversion of free fatty acids to DCA through ω-oxidation can be a further enhancement of carbon flow toward peroxisomal β-oxidation, particularly because there are no or limited other pathways in the cell for processing of free dicarboxylic acids. The availability of ω-oxidation-processing of free fatty acids in the modified cell is also beneficial to engineered production systems in which the target molecule (or an intermediate in target molecule production) is a dicarboxylic acid (e.g., adipic acid, suberic acid, sebacic acid, dodecanedioic acid, tetradecanedioic acid). For example, as shown in FIGS. 5 and 6, under certain conditions, a dicarboxylic acid processed in β-oxidation can be converted into a shorter chain diacid which can be secreted from the cell as a target molecule upon removal of the coenzyme A carrier via hydrolysis catalyzed by peroxisomal thioesterase. Thus, the ω-oxidation pathway in a modified cell can serve as a cellular gateway for funneling internalized fatty acids into oxidative metabolism and target molecule production and away from cytosolic activation. Modification of ω-oxidation activity is another potential enhancement of these embodiments. For example, if a host cell or organism (e.g., *Candida* spp, *Yarrowia* spp, *Bacillus* spp, *Blastobotrys* spp) expresses an endogenous ω-oxidation pathway, one or more enzymes (e.g., monooxygenase, cytochrome P450 reductase, such as CPRB, and others) of the pathway can be modified (e.g., as described herein) to increase catalytic activity and/or alter substrate specificity in order to increase fatty acid processing in the pathway and/or target specific fatty acids for processing into dicarboxylic acids. If a host cell or organism does not express an endogenous ω-oxidation pathway, it can be genetically modified to express heterologous enzymes to engineer an ω-oxidation pathway in the cell or organism.

In an oxidative metabolism-enhanced platform system, dicarboxylic acids, such as those generated by ω-oxidation, can traverse the peroxisomal membrane and move into peroxisomes where they can be activated via thioesterification to a dicarboxylic acid ester (shown as DCA-CoA in FIGS. 5 and 6) and enter β-oxidation ("β-ox" in FIGS. 5 and 6). In each cycle of β-oxidation, fatty acids are degraded through removal of two carbons from the carbon chain which are released as acetyl-CoA. The remaining fatty acid carbon chain can reenter another cycle of oxidation as an acyl-CoA shortened by two carbons atoms. Through successive cycles, a monocarboxylic fatty acid can be completely degraded such that only acetyl-CoA (for fatty acids with an even number of carbon atoms in the chain) or propionyl-CoA (for fatty acids with an odd number of carbon atoms in the chain) remains. Through successive cycles of β-oxidation of a dicarboxylic acid, the molecule can be completely degraded such that only succinyl-CoA (for fatty diacids with an even number of carbon atoms in the chain) or malonyl-CoA (for fatty diacids with an odd number of carbon atoms in the chain) remains. Thus, in these platform systems, the enhanced movement of fatty acids toward degradation via β-oxidation can yield acetyl-CoA (which can be used in target molecule production), and, in certain instances as described herein, shorter chain diacids at the completion of the oxidative process. A short-chain diacid thus produced can be a final target molecule (or a precursor or intermediate in the production of a target molecule).

The oxidative metabolism aspect of some platform systems, such as those shown in FIGS. 5 and 6, can be further enhanced through modification of β-oxidation activity. For example, one or more enzymes (e.g., acyl-CoA oxidase, ketoacyl-CoA thiolase, multifunctional enzyme hydratase and/or dehydrogenase, and others) of the pathway can be modified (e.g., as described herein) to increase catalytic activity and/or alter substrate specificity in order to increase fatty acid processing in the pathway and/or select for specific fatty diacids for processing into target dicarboxylic acids. One example of a modification of β-oxidation activity, as described herein, is alteration of the substrate specificity of one or more acyl-CoA oxidase enzymes in the pathway, such as Pox4 and/or Pox5 of *Candida* yeast strains. In so doing, the process can be optimized for the production of fatty diacids of particular carbon chain lengths. For example, by genetically modifying a host cell or microorganism to decrease or eliminate Pox4 expression and/or activity in the host (e.g., *Candida*), the amount of shorter-chain (e.g., having less than about 8-10 carbons) fatty acids or diacids resulting from β-oxidation of longer chain fatty acids can be increased. Production of fatty acids or diacids of particular lengths can also be enhanced by genetically modifying (e.g., mutagenesis of the gene coding sequence to alter the encoded amino acid sequence) the activity of another acyl-CoA oxidase, such as Pox5, to alter the substrate specificity. For example, as described herein, some alterations of a *Candida* Pox5 amino acid sequence increase activity of the enzyme on C8 substrates and provide for a relative increase in the amount of C6 diacid (adipic acid) produced and decrease in the amount of C8 and longer diacids resulting from β-oxidation of a longer chain fatty acid. Thus, the platform system shown in FIGS. 5 and 6 can also serve as a production system for diacids of particular carbon chain lengths. Additional optional modifications that can provide for enhanced carbon flux through β-oxidation (and enhanced target molecule production) in these systems include, but are not limited to, modification of β-oxidation-associated activities, such as peroxisome biogenesis and proliferation activities. For example, as described herein, the abundance and/or volume of peroxisomes in which β-oxidation occurs can be increased in host cells through genetic modification. An example of such a modification is increasing the transcription of, and/or number of copies of, one or more peroxin-encoding nucleic acids (e.g., PEX11) in a host cell. Amplification of such peroxin-encoding nucleic acids and/or activities can lead to an overall increased β-oxidation capacity.

One feature of the carbon recycle loops of the platform systems shown in FIGS. 5 and 6 is the management and capture of acetyl-CoA generated during β-oxidation. Peroxisomal acetyl-CoA generally has two main fates: (i) conversion to acetyl-carnitine for transfer to mitochondria for use in the TCA cycle and (ii) the generation of malate in the glyoxylate cycle ("GlyOx" in FIGS. 5 and 6) which is then used in gluconeogenesis or moves into mitochondria. In unmodified cells, these uses of acetyl-CoA generated in β-oxidation represent loss of carbon atoms that could be used in target molecule production. Through modifications that are a part of the platform systems shown in FIGS. 5 and 6, acetyl groups can be captured either (1) as they move through the cytosol toward the mitochondria in the form of acetyl-carnitine or (2) in the form of acetate generated in peroxisomes. In capturing these acetyl group carbons, they thus can be diverted from the TCA cycle.

Capture of Carbon from Acetyl-Carnitine

In the example platform system depicted in FIG. 5, modifications in the host cell that enhance the capture and diversion of acetyl group carbon include, but are not limited to, modification of acetyl-carnitine entry into mitochondria, and modification of conversion of cytosolic acetyl-carnitine to acetyl-CoA. As described herein, unmodified cells may contain a cytosolic carnitine acetyltransferase activity for conversion of cytosolic acetyl-carnitine to acetyl-CoA. However, in some instances, it may not be as catalytically active and/or abundant as it is in organelles, e.g., peroxisomes and mitochondria. In a platform system provided herein and depicted in FIG. 5, one modification that can be made to enhance capture of acetyl groups in the cytosol is to increase the amount and/or activity of cytosolic carnitine acetyltransferase. As described herein, methods of achieving this include increasing the copy number of nucleic acids encoding cytosolic carnitine acetyltransferase in the cell, increasing the transcription of such nucleic acids and/or introducing nucleic acid encoding a more active cytosolic carnitine acetyltransferase enzyme into the cell (e.g., modifying an endogenous cytosolic enzyme activity by replacing it with, or adding to it, a heterologous enzyme activity). For example, in one embodiment described herein, a *Candida* mitochondrial/peroxisomal carnitine acetyltransferase (e.g, Cat2) with greater catalytic activity than an endogenous *Candida* cytoplasmic carnitine acetyltransferase (e.g., Yat1) can be recombinantly expressed cytosolically in a host cell by engineering a nucleic acid encoding the more active enzyme such that the encoded enzyme lacks a mitochondrial (and a peroxisomal) targeting sequence of amino acids (shown, as CAT2$^{cyt}$ in FIG. 5; see also, e.g., amino acid SEQ ID NO: 4 and a nucleotide sequence (SEQ ID NO: 61) encoding the amino acid sequence). Once acetyl-carnitine in transit from the peroxisomes to the mitochondria has been converted to acetyl-CoA in the cytosol by carnitine acetyltransferase activity in the cytosol (e.g., CAT2$^{cyt}$), it cannot cross the mitochondrial inner membrane and is diverted from the TCA cycle. This acetyl-CoA is now available for use in target molecule production. The amount of carnitine acetyltransferase activity in the cytosol of such a modified cell or organism can be further increased by using a strong and/or fatty acid-inducible heterologous promoter (e.g., a yeast HDE gene promoter) to regulate transcription of the engineered nucleic acid encoding a carnitine acetyltransferase activity.

Another modification that can enhance cytosolic capture and diversion of acetyl moieties in cells is an alteration of acetyl-carnitine uptake into mitochondria from the cytosol (shown as faded, dotted reaction arrow lines into and in the mitochondrial compartment in FIG. 5). One method of modifying mitochondrial acetyl-carnitine uptake is by altering the processing of acetyl-carnitine that occurs in the mitochondria to convert it to acetyl-CoA for use in the TCA cycle. For example, by decreasing the amount and/or activity level of the enzyme that catalyzes this processing, i.e., mitochondrial carnitine acetyltransferase, there can be a corresponding decrease in conversion of acetyl-carnitine to acetyl-CoA in the mitochondria. Without being limited or bound by theory, this can introduce a bottleneck in acetyl-carnitine processing in the mitochondria which slows acetyl-CoA entry into the TCA cycle. If the mitochondrial carnitine acetyltransferase activity is not sufficient to handle the acetyl carbon flux coming from the peroxisome, then the cytoplasmic acetyl-carnitine concentration should build up and, in effect, acetyl-carnitine is diverted from the TCA cycle. The increased concentration of cytoplasmic acetyl-carnitine can thus be a source of substrate for carnitine acetyltransferase activity in the cytosol which converts the substrate to cytosolic acetyl-CoA for use in target molecule production. The amount and/or activity of mitochondrial carnitine acetyltransferase can be decreased in a number of ways, as described herein. For example, the number of copies of nucleic acid encoding the enzyme in a host cell can be reduced (e.g, an endogenous gene encoding the enzyme can be disrupted or deleted), the transcription of such nucleic acid can be decreased and/or nucleic acid encoding a less active mitochondrial carnitine acetyltransferase enzyme can be introduced into the cell (i.e., replacing the endogenous mitochondrial enzyme with a heterologous enzyme). For example, in one embodiment described herein, a *Candida* cytoplasmic carnitine acetyltransferase (e.g, Yat1) which is less active than an endogenous *Candida* mitochondrial carnitine acetyltransferase (e.g., Cat2) can be recombinantly expressed in a host cell mitochondria by engineering a nucleic acid encoding the less active enzyme such that the encoded enzyme includes a mitochondrial targeting sequence of amino acids (shown as "CAT2" in a diagonal line-hatched background in the mitochondria in FIG. 5; see also, e.g., amino acid SEQ ID NOS: 10, 11 and 12 and nucleotide SEQ ID NOS: 67, 68 and 69 encoding such amino acid sequences). The modified nucleic acid can be introduced into a host cell in which the endogenous mitochondrial carnitine acetyltransferase gene has been disrupted or deleted. Although not specifically indicated in FIG. 5, in some cells and organisms (e.g., *Candida* spp), an endogenous gene encoding a mitochondrial carnitine acetyltransferase may also encode the cell's peroxisomal carnitine acetyltransferase. For example, such a gene can encode an enzyme that includes mitochondrial and peroxisomal targeting sequences for localization to each of these areas of the cell. If the gene encoding an endogenous mitochondrial carnitine acetyltransferase in such a cell is disrupted or deleted, it may be optimal (e.g., for cell viability and/or efficient processing of peroxisomal acetyl-CoA) to introduce a heterologous nucleic acid encoding carnitine acetyltransferase that includes a peroxisomal targeting sequence into the cell.

Another method of modifying mitochondrial acetyl-carnitine uptake is by altering a transport mechanism that moves acetyl-carnitine into the mitochondrial matrix, e.g., an acetyl-carnitine translocase. A mitochondrial inner-membrane transport protein (e.g., Crc1p) may function as an acetyl-carnitine transporter providing for transport of acetyl-carnitine into the mitochondrial matrix. By decreasing the amount and/or activity level of the transport protein, movement of acetyl-carnitine from the cytosol into mitochondria can be reduced thereby increasing the concentration of acetyl-carnitine in the cytosol that can be converted to acetyl-CoA by cytoplasmic carnitine acetyltransferase. The amount and/or activity of mitochondrial acetyl-carnitine transport protein can be decreased in a number of ways, as described herein. For example, the number of copies of nucleic acid encoding a mitochondrial acetyl-carnitine transport protein in a host cell can be reduced (e.g, an endogenous gene encoding the protein can be disrupted or deleted), the transcription of such nucleic acid can be decreased and/or nucleic acid encoding a less active transport protein can be introduced into the cell (e.g., replacing the endogenous mitochondrial transport protein with a heterologous protein). For example, in one embodiment described herein, the transcription of nucleic acid encoding a *Candida* acetyl-carnitine translocase (shown as "CRC1" in a diagonal line-hatched background in FIG. 5) can be reduced in a host cell by introducing such nucleic acid, which is operably linked to a heterologous promoter (e.g., a yeast glucose-6-phosphate isomerase gene promoter such as, for example, SEQ ID NO: 118) that provides for less transcription and/or a reduced transcription rate, and/or that can be regulated to provide for alternately weak and stronger transcription, into host cells in which the endogenous gene has been disrupted. The resulting reduction in transcription of the nucleic acid results in decreased amounts of the transporter protein in the mitochondrial membrane of modified cells. Thus, modification of mitochondrial acetyl-carnitine transporter expression and/or mitochondrial carnitine acetyltransferase activity, as shown in FIG. 5, can serve to divert acetyl-carnitine from use in the TCA cycle and increase the concentration of acetyl-carnitine in the cytosol of cells including one or more of these modifications. This, combined with increased amounts and/or activity of cytosolic carnitine acetyltransferase can result in increased amounts of acetyl-CoA available in the cytosol for use in target molecule production. Although all three of these modifications, i.e., alteration of mitochondrial carnitine acetyltransferase activity (e.g., Cat2), alteration of mitochondrial acetyl-carnitine transporter protein activity (e.g., Crc1) and modification of cytosolic carnitine acetyltransferase activity (e.g., Yat1), are shown in the depiction of an example platform system in FIG. 5, each can be used singly or in any combination in modifying carbon processing in cells or microorganisms for the production of target molecules. For example, modifications of a host cell in generating a platform and/or production system with respect to these three modifications include, but are not limited to: (1) a decreased mitochondrial carnitine acetyltransferase expression and/or activity and an increased cytosolic carnitine acetyltransferase expression and/or activity, (2) a decreased mitochondrial acetyl-carnitine transporter protein expression and/or activity and an increased cytosolic carnitine acetyltransferase expression and/or activity, (3) a decreased mitochondrial carnitine acetyltransferase expression and/or activity, a decreased mitochondrial acetyl-carnitine transporter protein expression and/or activity, and an increased cytosolic carnitine acetyltransferase expression and/or activity, (4) a decreased mitochondrial carnitine acetyltransferase expression and/or activity, and a decreased mitochondrial acetyl-carnitine transporter protein expression and/or activity, (5) a decreased mitochondrial carnitine acetyltransferase expression and/or activity, (6) a decreased mitochondrial acetylcarnitine transporter protein expression and/or activity and (7) an increased cytosolic carnitine acetyltransferase expression and/or activity.

Capture of Carbon from Acetate

In the platform system depicted in FIG. 6, another example of a modification of a host cell that can enhance the capture and diversion of acetyl group carbons that have been generated in β-oxidation is modification of acetyl-CoA processing in peroxisomes. In a cell that does not include such a modification, acetyl-CoA generated during the degradation of fatty acids in β-oxidation typically is converted by peroxisomal carnitine acetyltransferase into acetyl-carnitine for transport into the cytosol and eventually to the mitochondria. The engineered carbon recycling loop of the embodiment of the platform system depicted in FIG. 6 can capture the acetyl group carbons through conversion of peroxisomal acetyl-CoA into acetate. The acetate readily traverses the peroxisomal membrane and can move into the cytosol where it can be reconverted to acetyl-CoA and thus diverted from entry into, and loss to, mitochondrial metabolism.

Modification of peroxisomal acetyl-CoA processing in a host cell can be accomplished, for example, as described herein. Peroxisomal acetyl-CoA can be converted to acetate through hydrolysis catalyzed by acetyl-CoA hydrolase which also liberates coenzyme A for reuse in β-oxidation. A cell or microorganism may be modified to increase (or introduce) acetyl-CoA hydrolase and/or acetyl-CoA hydrolase activity in the peroxisomes. For example, the copy number of nucleic acids encoding a peroxisomal acetyl-CoA hydrolase in the cell can be increased, transcription of such nucleic acids can be increased and/or, if a cell expresses an endogenous peroxisomal acetyl-CoA hydrolase, a nucleic acid encoding a more active hydrolase enzyme can be introduced into the cell (e.g., modifying an endogenous peroxisomal hydrolase enzyme activity by replacing it with, or adding to it, a heterologous enzyme activity). For example, in one embodiment described herein, a *Candida* acetyl-CoA hydrolase (e.g, Ach) that is expressed in mitochondria of unmodified cells can be recombinantly expressed in host cell peroxisomes by engineering a nucleic acid encoding the enzyme such that the encoded protein lacks a mitochondrial targeting sequence of amino acids and includes a peroxisomal targeting sequence (shown as ACH in the peroxisomal compartment in FIG. 6; see e.g, amino acid SEQ ID NO: 16 and a nucleotide sequence (SEQ ID NO: 73) encoding the amino acid sequence). The amount of acetyl-CoA hydrolase activity in peroxisomes of such a modified cell or organism can be further increased by using a strong and/or fatty acid-inducible heterologous promoter (e.g., a yeast HDE gene promoter) to regulate transcription of the engineered nucleic acid encoding an acetyl-CoA hydrolase activity. In order to reduce or eliminate peroxisomal conversion of acetyl-CoA to acetyl-carnitine (shown as "Ac-Cam" in the peroxisome compartment of FIG. 6) so that a maximal amount of the acetyl-CoA is converted to acetate, the host cell can also be modified to decrease or eliminate (e.g., by disrupting or deleting a gene encoding peroxisomal carnitine acetyltransferase) carnitine acetyltransferase activity in the peroxisomes (shown in FIG. 6 as "cat2Δ" in a black oval).

Once in the cytoplasm, the acetate can be converted to acetyl-CoA by acetyl-CoA synthetase (shown as "ACS" in FIG. 6) which catalyzes the ligation of acetate and coenzyme A to produce acetyl-CoA. To provide optimal processing of the increased cytosolic acetate generated in this embodiment into cytosolic acetyl-CoA, the amount and/or activity of cytosolic acetyl-CoA synthetase can be increased in modified host cells or organisms. For example, the copy number of nucleic acids encoding a cytosolic acetyl-CoA synthetase in the cell can be increased, transcription of such nucleic acids can be increased (e.g., using a heterologous strong and/or fatty acid-inducible promoter, for example, a yeast HDE gene promoter) and/or a nucleic acid encoding a more active acetyl-CoA synthetase enzyme can be introduced into the cell (e.g., modifying an endogenous cytosolic acetyl-CoA synthetase enzyme activity by replacing it with, or adding to it, a heterologous enzyme activity).

As described herein, in some host cells or organisms, e.g., some yeast species, such as *Candida*, peroxisomal and mitochondrial carnitine acetyltransferase may be encoded by the same gene which can contain two in-frame start codons. Carbon source-dependent alternate transcription initiation can result in expression of a carnitine acetyltransferase initiated from the first start codon or a shorter carnitine acetyltransferase initiated from the second start codon.

The longer version of carnitine acetyltransferase encodes an N-terminal mitochondrial targeting signal whereease the shorter version does not. Therefore, in an embodiment in which a peroxisomal carnitine acetyltransferase activity is decreased by disruption or deletion of the corresponding gene in such cells, the mitochondrial carnitine acetyltransferase activity may also be decreased or eliminated. Therefore, because cell survival may require a minimal amount of energy generated through mitochondrial metabolism which in turn requires a supply of acetyl-CoA, a host cell or microorganism for the platform system shown in FIG. 6 can also be modified to express a mitochondrial carnitine acetyl transferase. This can be accomplished by introducing a recombinant nucleic acid encoding a carnitine acetyltransferase that includes a mitochondrial targeting sequence of amino acids into the host cell or microorganism. Because a system such as that shown in FIG. 6 is designed to direct most of the acetyl group carbons from acetyl-CoA generated in β-oxidation to the next segment of the carbon recycling loop (i.e., cytosolic fatty acid synthesis), the recombinant mitochondrial carnitine acetyltransferase can be one with reduced catalytic activity relative to the endogenous mitochondrial carnitine acetyltransferase (e.g., a Yat1 enzyme instead of a Cat2 enzyme). This can serve to minimize the rate at which any acetyl-carnitine that does enter the mitochondria is converted to acetyl-CoA which, in turn, could minimize the amount of carbon loss to mitochondrial metabolism at the expense of the recycling mechanism in this system. Loss of carbon to mitochondrial metabolism could also be minimized (in addition to, or as an alternative to, introducing nucleic acid encoding a less active mitochondrial carnitine acetyltransferase) by decreasing the amount and/or activity level of a mitochondrial acetyl-carnitine translocase (e.g., Crc1) into the system shown in FIG. 6. This can result in slowing of acetyl-carnitine transport into mitochondria and serve to divert some of the cytoplasmic acetyl-carnitine from use in the TCA cycle. Although both of these modifications, i.e., alteration of mitochondrial carnitine acetyltransferase activity (e.g., Cat2) and alteration of mitochondrial acetyl-carnitine transporter protein activity (e.g., Crc1), are shown in the depiction of an example platform system in FIG. 6, each can be used singly or in combination in modifying carbon processing in cells or microorganisms for the production of target molecules.

Additionally, because the only cytoplasmic acetyl-carnitine being generated in the system shown in FIG. 6 is through the carnitine acetyltransferase activity present in the cytosol (e.g., endogenous Yat1p in a *Candida* cell), the amount of acetyl-carnitine available to mitochondria is limited due to competition between the cytosolic carnitine acetyltransferase and acetyl-CoA carboxylase (shown as "ACC1" in FIG. 6) for the acetyl-CoA substrate. In some instances, it may be optimal to increase the amount and/or activity of carnitine acetyltransferase in the cytosol in a system such as that depicted in FIG. 6 in order to insure sufficient generation of acetylcarnitine for any minimal amount of acetylcarnitine that may be needed for mitochondrial metabolism. This can be accomplished, for example, by increasing the copy number of nucleic acids encoding cytosolic carnitine acetyltransferase in the cell, increasing the transcription of such nucleic acids and/or introducing nucleic acid encoding a more active cytosolic carnitine acetyltransferase enzyme into the cell (e.g., modifying an endogenous cytosolic enzyme activity by replacing it with, or adding to it, a heterologous enzyme activity (e.g., Cat2p)).

Redirecting Carbon Flow Toward Fatty Acid Biosynthesis

At this point in an acetyl group carbon recycling loop, such as that illustrated in the systems depicted in FIGS. 5 and 6, when acetyl moieties are accumulated in the cytosol as acetyl-CoA, they are primarily directed into the cytosolic fatty acid synthesis pathway to regenerate fatty acids. Cytoplasmic acetyl-CoA can be converted into malonyl-CoA, which can be a carbon donor in the synthesis of a fatty acid chain in repeated cycles of the addition of 2 carbon atoms per cycle to extend the chain and generate a fatty acid. The reactions of each cycle are typically catalyzed by fatty acid synthase (FAS) and generally continue until a 16- or 18-carbon fatty acid (palmitic acid or stearic acid) is completed in the form of palmitoyl-CoA or stearoyl-CoA. To enhance flow of the accumulated cytosolic acetyl-CoA into the fatty acid biosynthesis pathway, the process of converting acetyl-CoA into malonyl-CoA can optionally be modified in host cells or microorganisms. For example, the amount and/or activity of an enzyme that can catalyze the reaction, acetyl-CoA carboxylase, can be modified, e.g., increased, in host cells or microorganisms using genetic engineering methods as described herein (e.g., increasing the copy number and/or transcription of nucleic acid encoding acetyl-CoA carboxylase, increasing the activity of the enzyme by introducing nucleic acid encoding a modified amino acid sequence of the enzyme into host cells). In one embodiment described herein, the activity of a yeast (e.g., Candida) cytosolic acetyl-CoA carboxylase (shown as "ACC1" in a diagonal line-hatched background oval in FIGS. 5 and 6) can be increased through substitution of phosphorylatable serine residues with alternate (e.g., alanine) residues to reduce inhibition of the enzyme by phosphorylation (see, e.g., SEQ ID NO: 19). Heterologous nucleic acid encoding the modified protein can be introduced into a host cell for expression of the enzyme therein. Increasing the amount and/or activity of acetyl-CoA carboxylase can reduce or prevent any limitation on flow of accumulated acetyl-CoA into fatty acid biosynthesis due to insufficient enzyme activity. The amount of cytosolic acetyl-CoA carboxylase activity in such a modified cell or organism can also be increased by using a strong and/or fatty acid-inducible heterologous promoter (e.g., a yeast HDE gene promoter) to regulate transcription of the engineered nucleic acid encoding an acetyl-CoA carboxylase activity.

Additional optional modifications of cells or organisms to enhance the platform systems shown in FIGS. 5 and 6 include increasing the amount, activity, and/or altering the specificity, of enzymes in the fatty acid synthesis (FAS) enzyme complex, shown as "FAS" in FIGS. 5 and 6 (e.g., the enzyme activities of the FAS1 and FAS2 subunits of yeast).

A fatty acid synthase (e.g., FAS) activity can catalyze a series of decarboxylative Claisen condensation reactions from acetyl-CoA and malonyl-CoA. Without being limited or bound by any theory, it is believed that following each round of elongation the beta keto group is reduced to the fully saturated carbon chain by the sequential action of a ketoreductase activity, a dehydratase activity, and an enol reductase activity. In the case of Type I FAS enzymes, the growing fatty acid chain typically is carried between these active sites while attached covalently to the phosphopantetheine prosthetic group of an acyl carrier protein (ACP), and can be released by the action of a thioesterase (TE) upon reaching a carbon chain length of, for example, 16 (e.g., palmitic acid). In some instances, the collection of activities is found in a multifunctional, multi-subunit protein complex (e.g., Type I FAS activity). A fatty acid synthase enzyme (FAS) can be coded by fatty acid synthase subunit alpha (FAS2) and fatty acid synthase subunit beta (FAS1) genes. Thus, a fatty acid synthase activity usually includes a collection of activities (e.g., an enzymatic system) that perform functions associated with the synthesis of fatty acids. Therefore, the terms "fatty acid synthase activity", "fatty acid synthase", "FAS", and "FAS activity", as used herein refer to a collection of activities, or an enzymatic system, that perform functions associated with the synthesis of fatty acids. Fatty acid synthase activity may be amplified by over-expression of the FAS2 and/or FAS1 genes by any suitable method. Non-limiting examples of methods suitable to amplify or over express FAS2 and FAS1 genes include amplifying the number of FAS2 and/or FAS1 genes in a host cell following transformation with a high-copy number plasmid (e.g., such as one containing a 2u origin of replication), integration of multiple copies of FAS2 and/or FAS1 genes into the host genome, over-expression of the FAS2 and/or FAS1 genes directed by a strong and/or fatty acid-inducible promoter, the like or combinations thereof. Examples of polynucleotides from Candida strain ATCC 20336 that encode fatty acid synthase molecules (FAS1, FAS2) are provided herein (SEQ ID NOS: 102 and 103) and are also described in International patent application no. PCT/US2012/056562 (publication no. WO 2012/056562).

Redirecting Synthesized Fatty Acids Toward ω- and β-Oxidation

A typical product of cytosolic fatty acid synthesis is an acyl-CoA (e.g., palmitoyl- or stearoyl-CoA), which is shown as "FA-CoA" in FIGS. 5 and 6. Because this is an activated (i.e., thioester) form of a fatty acid, it can be used in cellular metabolic pathways (e.g., synthesis of triacylglycerides and phospholipids) other than desired engineered target molecule production processes. This represents a loss of the carbon atoms in the acyl-CoA which could have been incorporated into target products. To reduce loss of the cytosolic acetyl group carbons (now in the form of an acyl-CoA) captured in the recycling loop of the exemplary platform systems shown in FIGS. 5 and 6, the final segment of the loop often includes an engineered cytosolic thioesterase enzyme to, in effect, "deactivate" the fatty acid-CoA through hydrolysis and removal of coenzyme A. This can divert the carbons in the acyl-CoA from use in cellular processes not involved in target molecule production and/or generation of cytosolic acetyl-CoA and can complete the recycling loop by generating a cytosolic free fatty acid that can then begin the loop pathway at the initial point of ω-oxidation. Many cells (e.g., some eukaryotic cells, such as yeast) do not have a cytosolic thioesterase activity that is active on long-chain acyl-CoA substrates. Host cells that express an endogenous cytosolic thioesterase activity may also benefit from increasing the activity to enhance the flow of the acyl-CoA carbons through the final segment of the recycling loop. In the embodiment of the platform system shown in FIG. 5, a host cell can be modified to increase (in this case by introducing) a thioesterase activity in the cytosol in order to direct acyl-CoA carbon flux toward oxidative metabolism pathways (ω- and β-oxidation). This can be achieved using genetic engineering methods as described herein (e.g., increasing the copy number and/or transcription of nucleic acid encoding a thioesterase, increasing the activity of the enzyme by introducing nucleic acid encoding a modified amino acid sequence of the enzyme into host cells). For example, in one embodiment described herein, a *Candida* peroxisomal thioesterase (e.g, Tes) can be recombinantly expressed cytosolically in a host cell by engineering a nucleic acid encoding the enzyme such that the encoded enzyme lacks a peroxisomal targeting sequence of amino acids (shown, as TES3$^{cyt}$ in a diagonal line-hatched background oval in FIGS. 5 and 6; see also, e.g., nucleotide SEQ ID NO: 88 and encoded amino acid SEQ ID NO: 32). Some organisms, such as some yeast (e.g., *Candida*), for example, may express several distinct thioesterases (e.g., *Candida viswanathii* has 8 peroxisomal thioesterase genes) having varied activities. The activities of thioesterases encoded by different genes can be evaluated, using methods known in the art and/or described herein, to compare the enzymes and select the type and level of activity that is optimal for achieving conversion of cytosolic acyl-CoA to free fatty acid in a recycle loop such as the one depicted in FIGS. 5 and 6.

Another modification that can optionally be included in platform systems, such as those depicted in FIGS. 5 and 6, is a decrease in the amount and/or activity of, or elimination of, mechanisms for the transport of acyl-CoA across the peroxisomal membrane and into peroxisomes. This modification can be beneficial in embodiments in which a target molecule (or precursor or intermediate in the production of a target molecule) is a dicarboxylic acid. For example, the platform systems shown in FIGS. 5 and 6 can be used as a modified cell or microorganism for the enhanced production of dicarboxylic acids via w- and β-oxidation of a fatty acid or alkane carbon source. Feedstock fatty acid (or alkane) carbon atoms that would have been lost as acetyl-CoA formed during β-oxidation degradation of a long-chain diacid (that had been generated by ω-oxidation) in an unmodified cell are captured and used in the generation of additional target diacid molecules (e.g., adipic acid) through the engineered recycling loops in these diacid production systems. Thus, a recycling loop such as the one depicted in FIG. 5 or FIG. 6 can provide for enhanced, highly efficient fatty acid production by significantly reducing "waste" of feedstock carbons in other cellular processes not involved in target molecule production. When the target molecule is a diacid, the carbon atoms recycled through the cytosolic fatty acid synthesis segment of the loop can optimally be directed through the final loop segment of conversion of the synthesized acyl-CoA into free fatty acid so that the carbon atoms can be used again in generating more diacid target through ω- and β-oxidation. Therefore, it can be beneficial to reduce or eliminate any transport of the synthesized acyl-CoA across the peroxisomal membrane and into peroxisomes where it would directly enter into β-oxidation without first being converted to a diacid through ω-oxidation. This can be achieved through disruption or deletion of genes encoding peroxisomal acyl-CoA transporters. In one embodiment described herein, a yeast (e.g., *Candida*) peroxisomal transport protein (e.g, Pxa1) activity is decreased or eliminated by disrupting the gene encoding the protein in the host cell (e.g., shown as "pxa1Δ" in a black background oval in FIGS. 5 and 6).

Engineered Pathways for Capturing Carbon Atoms from the TCA Cycle

FIG. 7 depicts possible cellular modifications in an exemplary embodiment of a eukaryotic (i.e., yeast in this example) platform system designed to capture carbon atoms in the cytosol by enhancing carbon flow through cellular oxidative metabolism pathways (ω-oxidation and peroxisomal β-oxidation) and reducing flow of carbon into the endoplasmic reticulum and lipid particles (in the form of acyl-CoA). Thus, the amount of carbon that is lost to lipid-generating (e.g., glycerol-3-phosphate (G3P) and/or dihydroxyacetone phosphate (DHAP)) pathways at the expense of target molecule production can be reduced in this platform system. Although multiple, possible, cellular modifications are illustrated in FIG. 7, as described herein, some of the modifications depicted in the figure are optional enhancements of an exemplary engineered system and may or may not be included in a modified cell or organism depending on, for example, the intended use of the system (e.g., development of a particular single, or multiple, target molecule(s) production system) and the selection of variable features (e.g., host cell or organism, carbon source, regulatory controls (such as transcription control elements), culture conditions and the like) of the system. Thus, it is understood that any optional modifications set forth in the exemplary system shown in FIG. 7 are non-limiting and may or may not be included in a particular engineered system and, if included, may be in utilized in different combinations than illustrated in the figure.

In the system shown in FIG. 7, as in the embodiments of the platform systems depicted in FIGS. 5 and 6, carbon processing activities can be engineered to enhance carbon flow through cellular oxidative metabolism pathways, e.g., ω-oxidation and peroxisomal β-oxidation. However, unlike the embodiments depicted in FIGS. 5 and 6, carbon flow from the peroxisomes to the mitochondria is usually not decreased in the platform system shown in FIG. 7. Instead, a portion of the acetyl carbon that is allowed to be utilized in mitochondrial metabolism in this embodiment can be captured from citrate that moves out of the mitochondria and accumulates in the cytosol, particularly in conditions of low nitrogen and high carbon. In the cytosol, the citrate can be converted to oxaloacetate in a reaction which releases acetyl-CoA that, as in the embodiments depicted in FIGS. 5 and 6, can be directed into cytosolic fatty acid synthesis. Thus, this platform system can also include a form of an acetyl group carbon recycling loop that can capture acetyl moieties in the cytosol after they have participated in the TCA cycle in mitochondria instead of before they enter mitochondria as acetyl-carnitine. The carbon recycle loop is depicted in FIG. 7 by the dark, solid reaction arrows beginning with extracellular fatty acid internalization in the upper left corner of the figure. Starting with carbon internalization, the initial segments of the loop (i.e., carbon processing in ω-oxidation and β-oxidation yielding acetyl-CoA that moves out of the peroxisome and into the cytosol as acetyl-carnitine) are the same as those of the recycling loop shown in FIG. 5 until the point of the processing of cytosolic acetyl-carnitine. In the platform system shown in FIG. 7, acetyl group carbon can continue to flow unimpeded into mitochondria, typically in the form of acetyl-carnitine, and can be converted to acetyl-CoA, utilized in the TCA cycle, and then can be regenerated as acetyl-CoA in the cytosol from a TCA cycle intermediate, citrate ("Cit" in FIG.

7). From that point on, the processing of carbon in the recycling loop is typically similar to that of cytosolic acetyl-CoA in the systems shown in FIGS. 5 and 6. The acetyl-CoA can enter the final segments of the loop with the acetyl carbons being utilized in fatty acid synthesis to generate acyl-CoA which is then hydrolyzed to free fatty acid for re-entry into another cycle of the loop at the starting point of w-oxidation.

Many of the exemplary host cell or organism modifications in the platform system shown in FIG. 7 are the same as those in the platform system shown in FIG. 5, e.g., decreased or eliminated cytosolic acyl-CoA synthetase activity, increased amount and/or activity of cytosolic acetyl-CoA carboxylase and cytosolic thioesterase. Additionally, modifications to enhance w- and β-oxidation pathway activities and peroxisome proliferation, as well as to reduce transport of acyl-CoA into peroxisomes, can optionally be included in the engineering of a platform system shown in FIG. 7 in a host cell or organism. If a host cell or organism being modified to create a system shown in FIG. 7 does not express an endogenous cytosolic ATP citrate lyase activity (shown as "ACL1/2" in FIG. 7) to catalyze the conversion of citrate to oxaloacetate thereby releasing acetyl-CoA, it can be genetically modified to generate the enzyme activity. For example, one or more copies of a heterologous nucleic acid encoding an ATP citrate lyase operably linked to a suitable promoter element (e.g., a strong and/or fatty acid-inducible promoter such as a yeast HDE gene promoter) can be introduced into the cell or organism for recombinant expression of the activity. If a host cell or organism (for example, an oleaginous yeast) does express an endogenous cytosolic ATP citrate lyase activity, the activity can be increased using genetic engineering methods as described herein (e.g., increasing the copy number and/or transcription of nucleic acid encoding an ATP citrate lyase, increasing the activity of the enzyme by introducing nucleic acid encoding a modified amino acid sequence of the enzyme into host cells).

Capturing a portion of the acetyl-carbon that is utilized in mitochondrial metabolism in the form of citrate that moves out of the mitochondria and accumulates in the cytosol is a modification that can also be incorporated into the platform systems shown in FIGS. 5 and 6. For example, one or more copies of a heterologous nucleic acid encoding an ATP citrate lyase operably linked to a suitable promoter element can be introduced into the cell or organism modified as shown in FIG. 5 or FIG. 6 for expression of ATP citrate lyase activity in the cytosol and conversion of cytosolic citrate to oxaloacetate with concomitant release of acetyl-CoA. The released acetyl-CoA can then be utilized in the cytosolic fatty acid synthesis segment of the carbon recycle loop along with acetyl-CoA generated from acetate (as shown in FIG. 6) or from acetyl-carnitine (as shown in FIG. 5).

Engineered Pathways for Producing Fatty Acids

An example of a target molecule that can be produced using the modified cells or organisms and methods provided herein is a fatty acid. Examples of enhanced fatty acid-producing cell- or microbial-based systems provided herein include the systems depicted in FIGS. 5, 6 and 7. The fatty acid target molecule generation pathways in these examples center on a modified oxidative metabolism (ω- and β-oxidation) pathway through which a longer-chain hydrocarbon feedstock carbon source (e.g., fatty acids and/or alkanes) can be degraded to yield a shorter-chain target fatty acid molecule. In a typical unmodified cell or organism, the β-oxidation cycle releases two carbon atoms in the form of acetyl-CoA generated during chain shortening which, in eukaryotic cells, can then be used in other metabolic processes, including, for example, the TCA cycle after moving from the peroxisome to the mitochondria. In engineered cell- or organism-based production systems such as shown in FIGS. 5, 6 and 7, acetyl group carbons released during β-oxidation can be captured in the cytoplasm (e.g., as acetyl-carnitine, acetate and/or citrate) and converted back to acetyl-CoA so that they can be used for the synthesis of longer-chain fatty acids in the cytoplasm and eventually be incorporated into shorter-chain fatty acid target molecule product through, for example, modified oxidative metabolism. These high-efficiency systems can enhance fatty acid target molecule production by including an engineered carbon recycling loop that can increase the efficiency of fatty acid production and can provide greater target molecule yields by decreasing loss of feedstock carbons to cellular energy-generating and/or growth processes. This can be accomplished through rerouting carbon that would have been lost as acetyl-CoA during β-oxidation degradation back into the target molecule fatty acid product.

For example, one target fatty acid molecule that can be produced using cells or organisms modified to include a carbon-capturing recycling loop such as those shown in FIGS. 5, 6 and 7, is adipic acid, which is a 6-carbon dicarboxylic acid. A cell or microorganism that has been modified as shown in any of FIG. 5, 6 or 7, when provided with a fatty acid carbon source (e.g., a typical 18-carbon vegetable-oil fatty acid), can metabolize the fatty acid first through ω-oxidation, in which it can be converted to a diacid containing the same number of carbons as the fatty acid carbon source, e.g., 18 carbons, and can then metabolize the diacid through β-oxidation. The products of the first cycle of β-oxidation typically are a 16-carbon diacid and a 2-carbon acetyl-CoA molecule. The products of a second cycle of β-oxidation starting with the 16-carbon diacid are typically a 14-carbon diacid and another 2-carbon acetyl-CoA molecule. After four more cycles of β-oxidation, the 6-carbon adipic acid target molecule can be produced, in which case 6 molecules of acetyl-CoA (a total of 12 carbon atoms) will have been released into the peroxisome. In a cell- or microbial-based production system that does not include an engineered carbon recycling pathway such as those shown in FIGS. 5, 6 and 7, the 12 carbon atoms released during β-oxidation are usually not used in generating 2 more 6-carbon adipic acid target molecule products but would be "lost" to cellular metabolism pathways involved in energy generation and growth. Thus, only one-third of the source carbons would be used in product generation whereas two-thirds of the source carbons would be lost to processes that do not require all of the lost carbon in order for the cell or microbe to survive. However, cells and microbes modified as described herein to alter cellular carbon flux can capture more of the source carbon atoms and use them in generating more product. Accordingly, the modified cells and microorganisms provided herein as target molecule production systems can be significantly more efficient and can provide a greater product yield from a given amount of feedstock than cell- or microbial-based systems that have not been modified for enhanced production.

Engineered Malonyl-CoA-Producing Pathways in a Platform Target Molecule Production System FIG. 8 depicts possible cellular modifications in some embodiments of a eukaryotic (e.g., yeast in this example) platform system for the enhanced production of malonyl-CoA. Malonyl-CoA is a versatile precursor molecule in the synthesis of many industrially valuable molecules. Accordingly, a system such as that depicted in FIG. 8 can be used as a platform for incorporating pathways for target molecule production. Although multiple, possible, cellular modifications are illustrated in FIG. 8, as described herein, some of the modifications depicted in the figure are optional enhancements of an exemplary engineered system and may or may not be included in a modified cell or organism depending on, for example, the intended use of the system (e.g., development of a particular single, or multiple, target molecule(s) production system) and the selection of variable features (e.g., host cell or organism, carbon source, regulatory controls (such as transcription control elements), culture conditions and the like) of the system. Thus, it is understood that any optional modifications set forth in the exemplary system shown in FIG. 8 are non-limiting and may or may not be included in a particular engineered system and, if included, may be in utilized in different combinations than illustrated in the figure.

The cell-based platform system shown in FIG. 8 incorporates carbon flux modifications designed to capture carbon atoms as acetyl-CoA, the precursor to malonyl-CoA, in the cytosol by enhancing carbon flow through cellular oxidative metabolism pathways (ω-oxidation and peroxisomal β-oxidation) and reducing flow of carbon into mitochondria. Thus, the amount of carbon that is lost to the TCA cycle at the expense of malonyl-CoA production can be reduced in this platform system. At the core of this platform system are acetyl group diversion elements that impede the flow of acetyl group carbons into mitochondria and enhance flow of the carbons into generation of malonyl-CoA. These elements can optionally be combined with a carbon recycle loop that can capture any cytosolic acetyl moieties that are not funneled into the target molecule production pathway. Such cytosolic acetyl moieties can be captured in the fatty acid biosynthesis segment of the carbon recycle loop and can be used to regenerate an acyl-CoA that can be diverted from lipid synthesis and converted into a fatty acid that can be subjected to another cycle of peroxisomal β-oxidation (depicted as a dashed line extending from malonyl-CoA to FA-CoA in FIG. 8).

As set forth in connection with the description of the platform system shown in FIG. 5, carbon flux alteration in the system shown in FIG. 8 can begin with modifications, e.g., decreased acyl-CoA synthetase (Faa1 and/or Fat1) activity, that enhance carbon flow usually in the form of a fatty acid (from, for example, a fatty acid carbon source or derived from an alkane source) into ω- and β-oxidation pathways in the cell or organism. The oxidative metabolism aspect of the platform system can be further enhanced through optional modification of ω- and/or β-oxidation activity as described herein. For example, with respect to the ω-oxidation pathway, one or more enzymes (e.g., monooxygenase, cytochrome P450 reductase, such as CPRB, and others) of the pathway can be modified (e.g., as described herein) to increase catalytic activity and/or alter substrate specificity in order to increase fatty acid processing in the pathway and/or to target specific fatty acids for processing into dicarboxylic acids. If a host cell or organism does not express an endogenous ω-oxidation pathway, it can be genetically modified to express heterologous enzymes to engineer an ω-oxidation pathway in the cell or organism. Optional enhancements of the β-oxidation activity can include, for example, modification of one or more enzymes (e.g., acyl-CoA oxidase, ketoacyl-CoA thiolase, multifunctional enzyme hydratase and/or dehydrogenase, and others) of the pathway (e.g., as described herein) to increase catalytic activity and/or alter substrate specificity in order to increase fatty acid processing in the pathway and/or to target specific fatty diacids for processing into target dicarboxylic acids (in an instance in which the system shown in FIG. 8 could be used as a multiple target molecule production system, i.e., a "co-production" system). One example of a modification of β-oxidation activity, as described herein, is alteration of the substrate specificity of one or more acyl-CoA oxidase enzymes in the pathway, such as Pox4 and/or Pox5 of *Candida* yeast strains. Additional modifications that can provide for enhanced carbon flux through β-oxidation (and enhanced target molecule production) in these systems include, but are not limited to, modification of β-oxidation-associated activities, such as peroxisome biogenesis and proliferation activities. For example, as described herein, the abundance and/or volume of peroxisomes in which β-oxidation occurs can be increased in host cells through genetic modification. An example of such a modification is increasing the transcription of, and/or number of copies of, one or more peroxin-encoding nucleic acids (e.g., PEX11) in a host cell. Amplification of such peroxin-encoding nucleic acids and/or activities leads to an overall increased β-oxidation capacity.

Carbon capture modifications of this platform system, as in the system depicted in FIG. 5, occurring in the processing of the acetyl-CoA generated during β-oxidation can include diversion elements that can impede the flow of acetyl group carbons into mitochondria (e.g., decreasing mitochondrial carnitine transporters and carnitine acetyltransferase activities) and enhance flow of the carbons into generation of malonyl-CoA (e.g., increasing cytosolic carnitine acetyltransferase and acetyl-CoA carboxylase activities). Modifications in the host cell or organism that can enhance the capture and diversion of acetyl-CoA in the cytosol include, but are not limited to, modification of acetyl-carnitine entry into mitochondria and modification of conversion of cytosolic acetyl-carnitine to acetyl-CoA. As described herein, one modification that can be made to enhance capture of acetyl groups in the cytosol is to increase the amount and/or activity of cytosolic carnitine acetyltransferase which converts acetyl-carnitine into acetyl-CoA, a thioester form that cannot move into the mitochondrial matrix. Methods of achieving this include increasing the copy number of nucleic acids encoding cytosolic carnitine acetyltransferase in the cell, increasing the transcription of such nucleic acids and/or introducing nucleic acid encoding a more active cytosolic carnitine acetyltransferase enzyme into the cell (e.g., modifying an endogenous cytosolic enzyme activity by replacing it with, or adding to it, a heterologous enzyme activity; see, e.g., "CAT2$^{cyt}$" in FIG. 8). Another modification that can enhance cytosolic capture and diversion of acetyl moieties in cells is an alteration of acetyl-carnitine uptake into mitochondria from the cytosol (depicted as faded, dotted reaction arrow lines into and in the mitochondrial compartment in FIG. 8). One method of modifying mitochondrial acetyl-carnitine uptake can be altering the processing of acetyl-carnitine that occurs in the mitochondria to convert it to acetyl-CoA for use in the TCA cycle. For example, by decreasing the activity level of an enzyme that catalyzes this processing, e.g., mitochondrial carnitine acetyltransferase, there can be a corresponding decrease in conversion of acetyl-carnitine to acetyl-CoA in the mitochondria. Without being limited or bound by theory, if the mitochondrial carnitine acetyltransferase activity is not sufficient to efficiently process the acetyl carbon flux coming from the peroxisome, then the cytoplasmic acetyl-carnitine concentration should build up and, in effect, acetyl-carnitine can be diverted from the TCA cycle. The increased concentration of cytoplasmic acetyl-carnitine thus can be a source of substrate for carnitine acetyltransferase activity in the cytosol which can convert the substrate to cytosolic acetyl-CoA for use in target molecule production. The amount and/or activity of mitochondrial carnitine acetyltransferase can be decreased in a number of ways, as described herein. For example, the number of copies of nucleic acid encoding the enzyme in a host cell can be reduced, the transcription of such nucleic acid can be decreased and/or nucleic acid encoding a less active mitochondrial carnitine acetyltransferase enzyme can be introduced into the cell (e.g., replacing the endogenous mitochondrial enzyme with a heterologous enzyme; see, e.g., "CAT2" in a diagonal line-hatched background in the mitochondria in FIG. 8).

As also described with reference to FIG. 5, another method of modifying mitochondrial acetyl-carnitine uptake can be altering the transport mechanism that moves acetyl-carnitine into the mitochondrial matrix, e.g., an acetyl-carnitine translocase. By decreasing the amount and/or activity level of the transport protein, movement of acetyl-carnitine from the cytosol into mitochondria can be slowed and/or reduced thereby increasing the concentration of acetyl-carnitine in the cytosol that can be converted to acetyl-CoA by cytoplasmic carnitine acetyltransferase. The amount and/or activity of mitochondrial acetyl-carnitine transport protein can be decreased, for example, by reducing the number of copies of nucleic acid encoding a mitochondrial acetyl-carnitine transport protein in a host cell, reducing the transcription of such nucleic acid and/or introducing nucleic acid encoding a less active transport protein into the cell (e.g., replacing the endogenous mitochondrial transport protein with a heterologous protein). For example, in one embodiment described herein, the transcription of nucleic acid encoding a *Candida* acetyl-carnitine translocase (shown as "CRC1" in a diagonal line-hatched background in FIG. 8) can be reduced in a host cell by introducing such nucleic acid, which is operably linked to a heterologous promoter that provides for less transcription and/or a reduced transcription rate, and/or that can be regulated to provide for alternately weak and stronger transcription, into host cells in which the endogenous gene has been disrupted. Thus, modification of mitochondrial acetyl-carnitine transporter expression and/or mitochondrial carnitine acetyltransferase activity, as shown in FIG. 8, can serve to divert acetyl-carnitine from use in the TCA cycle and increase the concentration of acetyl-carnitine in the cytosol of cells that include one or more these modifications. This, combined with increased amounts and/or activity of cytosolic carnitine acetyltransferase, can result in increased amounts of acetyl-CoA available in the cytosol for use in target molecule production. As also described with reference to FIG. 5, although all three of these modifications, i.e., alteration of mitochondrial carnitine acetyltransferase activity (e.g., Cat2), alteration of mitochondrial acetyl-carnitine transporter protein activity (e.g., Crc1) and modification of cytosolic carnitine acetyltransferase activity (e.g., Yat1), are shown in the depiction of a platform system in FIG. 8, each can be used singly or in any combination in modifying carbon processing in cells or microorganisms for the production of malonyl-CoA and/or other target molecules.

At this point in the platform pathway system depicted in FIG. 8, when acetyl moieties are accumulated in the cytosol as acetyl-CoA, they can be directed into generation of malonyl-CoA. To enhance flow of the accumulated cytosolic acetyl-CoA toward malonyl-CoA generation, the process of converting acetyl-CoA into malonyl-CoA can be modified in host cells or microorganisms. For example, the amount and/or activity of an enzyme that catalyzes the reaction, acetyl-CoA carboxylase, can be modified, e.g., increased, in host cells or organisms using genetic engineering methods as described herein (e.g., increasing the copy number and/or transcription of nucleic acid encoding acetyl-CoA carboxylase, increasing the activity of the enzyme by introducing nucleic acid encoding a modified amino acid sequence of the enzyme into host cells). In one embodiment described herein, the activity of a yeast (e.g., *Candida*) cytosolic acetyl-CoA carboxylase (shown as "ACC1" in a diagonal line-hatched background oval in FIG. 8) can be increased through substitution of phosphorylatable serine residues with alternate (e.g., alanine) residues to reduce inhibition of the enzyme by phosphorylation. Heterologous nucleic acid encoding the modified protein can be introduced into a host cell for expression of the enzyme therein. Increasing the amount and/or activity of acetyl-CoA carboxylase can reduce or prevent any limitation on flow of accumulated acetyl-CoA into malonyl-CoA generation.

The system depicted in FIG. 8 serves as a platform that can be used in multiple ways. For example, as shown, the pathway can serve as an enhanced, high-efficiency malonyl-CoA production system that can be further modified for use in generating a target molecule in an engineered pathway that initiates with a malonyl-CoA precursor. Examples of this are provided herein in which cells or organisms modified to contain the platform system are genetically modified to express pathways for the production of 3-hydroxypropionic acid or triacetic acid lactone from malonyl-CoA. Additionally, the system depicted in FIG. 8 can be used in the co-production of a fatty dicarboxlic acid, e.g., adipic acid, and a target molecule generated using malonyl-CoA as a precursor in the synthesis pathway.

Cells or microorganisms that have been modified to incorporate the biological platform system depicted in FIG. 8 can be further modified depending on the purpose(s) for which the system is being used. For example, if the system is being used solely for the production of a target molecule synthesized from a malonyl-CoA precursor, then it may be beneficial to modify the cell or microorganism to decrease cytosolic fatty acid synthesis. A committed step in fatty acid biosynthesis is the conversion of cytoplasmic acetyl-CoA into malonyl-CoA. Malonyl-CoA can serve as a carbon donor in the synthesis of a fatty acid chain in repeated cycles of the addition of 2 carbon atoms per cycle to extend the chain and generate a fatty acid. The fatty acid synthesis (FAS) pathway in host cells or organisms can compete with any pathways for target molecule synthesis for the malonyl-CoA substrate produced in this platform system. Therefore, to enhance malonyl-CoA carbon atom flux toward target molecule synthesis and direct carbon flux away from fatty acid biosynthesis, a host cell or organism can be modified to alter FAS enzyme activities. Non-limiting examples of methods suitable to decrease the amount and/or activity of enzymes involved in fatty acid synthesis, e.g., FAS2 and FAS1 enzymes, include decreasing the number of nucleic acids encoding fatty acid synthase enzymes, such as FAS2 and/or FAS1, in a host cell (e.g., disruption or deletion of one or more genes) and reducing the transcription of nucleic acids encoding fatty acid synthase enzymes, e.g., FAS2 and/or FAS1 genes, by replacing an endogenous promoter of one or more genes with a weak and/or constitutive promoter, the like or combinations thereof. Examples of polynucleotides from *Candida* strain ATCC 20336 that encode fatty acid synthase molecules (FAS1, FAS2) are provided herein and are also described in International patent application no. PCT/US2012/056562 (publication no. WO 2012/056562).

If the platform system depicted in FIG. 8 is being used for co-production of a fatty dicarboxylic acid and a target molecule derived from malonyl-CoA, then it may be beneficial to either make no modifications of the FAS pathway activities or modify the host cell or organism to increase the amount, activity, and/or alter the specificity, of enzymes in the fatty acid synthesis (FAS) enzyme complex, shown as "FAS" in FIG. 8 (e.g., the enzyme activities of the FAS1 and FAS2 subunits of yeast). Examples of methods of altering fatty acid synthesis through modification of the amount and/or activity of fatty acid synthase enzymes (e.g., increasing cellular copy number of nucleic acids encoding one or more enzymes, increasing transcription of nucleic acids encoding one or more enzymes) are described herein. A system such as that shown in FIG. 8 being used for co-production of a fatty dicarboxylic acid and a target molecule derived from malonyl-CoA, could include modifications, such as those described herein, of one or more activities of the ω- and/or β-oxidation pathways to enhance production of a desired dicarboxylic acid as described herein (e.g., modification of acyl-CoA oxidases, such as Pox4 and Pox5, monooxygenase, cytochrome P450 reductase). Such a co-production system would be depicted in FIG. 8 as including another arrow extending from a dicarboxylic acid (DCA-CoA) in the peroxisome to an acyl-CoA and then to a chain-shortened diacid (as a result of β-oxidation, "β-Ox") as is shown in the systems depicted in FIGS. 5 and 6.

Additionally, the efficiency of the system for co-production of a dicarboxylic acid may optionally be enhanced by modifying the host cell or organism to introduce the final segment of the carbon recycling loop as described with reference to FIG. 5 (and shown at the top of FIG. 8 as a solid reaction arrow extending from "FA-CoA" to "FA" and including the "TES$^{cyt}$" thioesterase enzyme as catalyst). In platform systems depicted in FIG. 8 that include a functional FAS pathway, the final product of the cytosolic fatty acid synthesis is typically an acyl-CoA (e.g., palmitoyl-CoA), which is shown as "FA-CoA" in FIG. 8. To avoid loss of the carbon atoms in the acyl-CoA lipid synthesis pathways, and complete the carbon recycling loop, the host cell or organism can be modified to include an engineered cytosolic thioesterase enzyme to, in effect, "deactivate" the fatty acid-CoA through hydrolysis and removal of coenzyme A. This can divert the carbons in the acyl-CoA from use in cellular processes not involved in target molecule production and/or generation of cytosolic acetyl-CoA and can complete the recycling loop by generating a cytosolic free fatty acid that can then begin a new cycle of the loop pathway at the initial point of ω-oxidation. A host cell can be modified to increase (or introduce) a thioesterase activity in the cytosol in order to direct acyl-CoA carbon flux toward oxidative metabolism pathways (ω- and β-oxidation). This can be achieved using genetic engineering methods as described herein (e.g., increasing the copy number and/or transcription of nucleic acid encoding a thioesterase, increasing the activity of the enzyme by introducing nucleic acid encoding a modified amino acid sequence of the enzyme into host cells). For example, in one embodiment described herein, a Candida peroxisomal thioesterase (e.g, Tes) can be recombinantly expressed cytosolically in a host cell (shown as TES3$^{cyt}$ in a diagonal line-hatched background oval in FIG. 8).

Another modification that can optionally be included in, but that is not required for, platform systems, such as those depicted in FIG. 8, is a decrease in the amount and/or activity of, or elimination of, mechanisms for the transport of acyl-CoA across the peroxisomal membrane and into peroxisomes. This modification can be beneficial in embodiments in which one of the target molecules (or precursor or intermediate in the production of a target molecule) is a dicarboxylic acid. This is because if an acyl-CoA generated from fatty acid synthesis can move across the peroxisomal membrane and into peroxisomes, it could directly enter into β-oxidation without first being converted to a diacid through ω-oxidation. A reduction in the transfer of acyl-CoA into peroxisomes can be achieved through disruption or deletion of genes encoding peroxisomal acyl-CoA transporters. In one embodiment described herein, a yeast (e.g., Candida) peroxisomal transport protein (e.g, Pxa1) activity can be decreased or eliminated by disrupting the gene encoding the protein in the host cell (e.g., shown as "pxa1Δ" in a black background oval in FIG. 8).

Engineered Pathways for Producing 3-Hydroxypropionic Acid

Modified cells, organisms, compositions and methods provided herein can also be used for enhanced production of other organic acids, such as, for example, 3-hydroxypropionic acid (3HP). An example of an engineered production pathway for cell- or microbial-based synthesis of 3HP is shown in FIG. 9. This biochemical pathway is based in a synthetic method using malonyl-CoA as a precursor molecule and incorporates elements as described for the platform system depicted in FIG. 8. As shown in FIG. 9, 3HP can be produced from malonyl-CoA in a 2-step reduction process. In the first step, malonyl-CoA ("Mal-CoA" in FIG. 9) can be reduced to malonate semialdehyde (MSA) in a reaction catalyzed by malonyl-CoA reductase (e.g., EC 1.2.1.75; "MCR" in FIG. 9). Malonate semialdehyde can be further reduced to 3HP in a reaction catalyzed by 3-hydroxy-propionate-dehydrogenase (e.g., EC 1.1.1.59; "HPD1" in FIG. 9). If a host cell or organism being modified to create a system shown in FIG. 9 does not express an endogenous cytosolic malonyl-CoA reductase or 3-hydroxy-propionate-dehydrogenase activity, it can be genetically modified to generate one or both of the enzyme activities. For example, one or more copies of a heterologous nucleic acid encoding an Mcr (e.g., nucleotide SEQ ID NO: 323 or any nucleotide sequence encoding amino acid SEQ ID NO: 322) or Hpd1 (e.g., nucleotide SEQ ID NO: 104 or any nucleotide sequence encoding amino acid SEQ ID NO: 48) operably linked to a suitable promoter element (e.g., a strong and/or fatty acid-inducible promoter such as a yeast HDE gene promoter) can be introduced into the cell or organism for recombinant expression of the activity. If a host cell or organism does express an endogenous cytosolic malonyl-CoA reductase and/or 3-hydroxy-propionate-dehydrogenase activity, the activity may be increased using genetic engineering methods as described herein (e.g., increasing the copy number and/or transcription of nucleic acid encoding an Mcr or Hpd1, increasing the activity of the enzyme by introducing nucleic acid encoding a modified amino acid sequence of the enzyme into host cells). Nucleic acid encoding an MCR activity can be obtained, for example, from bacteria, including, but not limited to, Sulfolobus islandicus (see, e.g, nucleic acid SEQ ID NO: 323 and encoded amino acid SEQ ID NO:322) Sulfolobus tokodaii (nucleotide sequence: EMBL-EBI accession no. BAB67276.2) strain 7 (DSMZ 16693; available from the Leibniz Institute DSMZ-German Collection of Microorganisms and cell lines). An example of a Candida viswanathii nucleotide sequence (SEQ ID NO:104) encoding an Hpd1 protein (amino acid SEQ ID NO:48) is provided herein. Nucleic acid encoding Hpd1 can be obtained from additional sources, for example, yeast strains such as Candida albicans (nucleotide sequence: Genbank accession no. XM_714034), e.g., strain SC5314 (ATCC No. MYA-2876). Methods for detecting the presence and/or activity of a malonyl Co-A reductase include spectrophotometric assays such as described by Alber et al. ((2006) *J. Bacteriol.* 188:8551-8559). Methods for detecting the presence and/or activity of a malonyl 3-hydroxy-propionate-dehydrogenase include assays such as described by Otzen et al. ((2014) *J. Biol. Chem.* 289(12):8151-8169).

Some cells and microbial hosts, e.g., yeast spp., may express an endogenous semialdehyde dehydrogenase (e.g., EC 1.2.1.18; Ald6p) enzyme that catalyzes the oxidation of malonate semialdehyde to acetyl-CoA and $CO_2$ which would result in loss of the MSA intermediate in the synthesis of 3HP. Therefore, a gene encoding a semialdehyde dehydrogenase in any such host cell or organism can be disrupted or deleted, for example, using gene disruption techniques known in the art and/or described herein, to decrease or eliminate the enzyme activity. An example of a *Candida viswanathii* nucleotide sequence (SEQ ID NO:105) encoding an Ald6 protein (amino acid SEQ ID NO:49) is provided herein. Additional nucleotide sequences encoding Ald6 include, but are not limited to, *Candida albicans* strain SC5314 ALD6 (Genbank accession no. XM-705897), *Saccharomyces cerevisiae* ALD6 (Genbank accession no. NM_001183875). Methods for detecting the presence and/or activity of a semialdehyde dehydrogenase include assays such as described by Otzen et al. ((2014) *J. Biol. Chem.* 289(12):8151-8169) and Banerjee et al. ((1970) *J. Biol. Chem.* 245:1828-1835).

As shown in FIG. 9, a cellular platform pathway enhanced for production of malonyl-CoA, such as that depicted in FIG. 8, can provide a highly compatible system for use in the efficient production of 3HP. The platform is designed to enable maximal use of a lower cost carbon source (e.g., fatty acid or alkane) through modifications of cellular carbon flux that can enhance flow of source carbons to the generation of the malonyl-CoA precursor in the reaction scheme for production of 3HP. The presence and/or amount of 3HP in a sample can be determined, for example, using analytical methods such as HPLC (see, e.g., Raj et al. (2008) *Process Biochem.* 43:1440-1446 and International patent application no. PCT/US2016/023243 (publication no. WO 2016/154046)).

Cells or organisms that have been modified to incorporate a 3HP production system such as that depicted in FIG. 9 can be further modified depending on the purpose(s) for which the system is being used. For example, if the system is being used solely for the production of 3HP, then it may be beneficial to modify the cell or organism to decrease cytosolic fatty acid synthesis (e.g., as described with respect to the system shown in FIG. 8). If the system depicted in FIG. 9 is being used for co-production of a fatty dicarboxylic acid and 3HP, then it may be beneficial to either make no modifications of the FAS pathway activities or modify the host cell or organism to increase the amount, activity, and/or alter the specificity, of enzymes in the fatty acid synthesis (FAS) enzyme complex, shown as "FAS" in FIG. 9 (and as described, for example, with respect to the system shown in FIG. 8). A system such as that shown in FIG. 9 being used for co-production of a fatty dicarboxylic acid and 3HP could also optionally include modifications, such as those described herein, of one or more activities of the ω- and/or β-oxidation pathways to enhance production of a desired dicarboxylic acid as described herein (e.g., modification of acyl-CoA oxidases, such as Pox4 and Pox5, monooxygenase, cytochrome P450 reductase). Such a co-production system would be depicted in FIG. 9 as including another arrow extending from a dicarboxylic acid (DCA-CoA) in the peroxisome to an acyl-CoA and then to a chain-shortened diacid (as a result of β-oxidation, "β-Ox") as is shown in the systems depicted in FIGS. 5 and 6.

Although multiple, possible, cellular modifications are illustrated in FIG. 9, as described herein, some of the modifications depicted in the figure are optional enhancements of an exemplary engineered system and may or may not be included in a modified cell or organism depending on, for example, the intended use of the system (e.g., development of a particular single, or multiple, target molecule(s) production system) and the selection of variable features (e.g., host cell or organism, carbon source, regulatory controls (such as transcription control elements), culture conditions and the like) of the system. Thus, it is understood that any optional modifications set forth in the exemplary system shown in FIG. 9 are non-limiting and may or may not be included in a particular engineered system and, if included, may be in utilized in different combinations than illustrated in the figure.

Engineered Pathways for Producing Polyketides

Modified cells, organisms, compositions and methods provided herein can also be used for enhanced production of polyketides, such as, for example, triacetic acid lactone (TAL). An example of an engineered production pathway for cell- or microbial-based synthesis of TAL is shown in FIG. 10. This biochemical pathway is based in a synthetic method using malonyl-CoA as a precursor molecule. As shown in FIG. 10, TAL can be produced from malonyl-CoA in two condensation reactions with acetyl-CoA catalyzed by 2-pyrone synthase (EC 2.3.1; "2PS" in FIG. 10). A malonyl-CoA-producing cell or organism can be genetically modified to express a 2-pyrone synthase enzymatic activity by introducing heterologous nucleic acid encoding the enzyme into a host cell or organism. For example, one or more copies of a heterologous nucleic acid encoding 2PS operably linked to a suitable promoter element (e.g., a strong and/or fatty acid-inducible promoter such as a yeast HDE gene promoter) can be introduced into the cell or organism for recombinant expression of the activity. Nucleic acid encoding a 2-pyrone synthase can be obtained, for example, from plant species such as *Gerbera hybrida* (e.g., nucleotide SEQ ID NO: 325 encoding amino acid SEQ ID NO: 324, and Genbank nucleotide sequence accession no. Z38097). The enzymatic activity of 2-pyrone synthase can be determined using a TLC-based radiometric assay as described by Jez et al. ((2000) *Chemistry and Biology* 7(12):919-930).

As shown in FIG. 10, a cellular platform pathway enhanced for production of malonyl-CoA, such as that depicted in FIG. 8, can provide a highly compatible system for use in the efficient production of TAL. The platform is designed to enable maximal use of a lower cost carbon source (e.g., fatty acid or alkane) through modifications of cellular carbon flux that can enhance flow of source carbons to the generation of the malonyl-CoA precursor in the reaction scheme for production of TAL. TAL concentrations can be determined using reversed-phase HPLC as described by Xie et al. ((2006) *Biotechnol Bioengineering* 93(4):727-736). Cells or organisms that have been modified to incorporate the TAL production system depicted in FIG. 10 can be further modified depending on the purpose(s) for which the system is being used. For example, if the system is being used solely for the production of TAL, then it may be beneficial to modify the cell or organism to decrease cytosolic fatty acid synthesis (e.g., as described with respect to the system shown in FIG. 8). If the system depicted in FIG.

10 is being used for co-production of a fatty dicarboxylic acid and TAL, then it may be beneficial to either make no modifications of the FAS pathway activities or modify the host cell or organism to increase the amount, activity, and/or alter the specificity, of enzymes in the fatty acid synthesis (FAS) enzyme complex, shown as "FAS" in FIG. 10 (and as described, for example, with respect to the system shown in FIG. 8). A system such as that shown in FIG. 10 being used for co-production of a fatty dicarboxylic acid and TAL could also optionally include modifications, such as those described herein, of one or more activities of the ω- and/or β-oxidation pathways to enhance production of a desired dicarboxylic acid as described herein (e.g., modification of acyl-CoA oxidases, such as Pox4 and Pox5, monooxygenase, cytochrome P450 reductase). Such a co-production system would be depicted in FIG. 10 as including another arrow extending from a dicarboxylic acid (DCA-CoA) in the peroxisome to an acyl-CoA and then to a chain-shortened diacid (as a result of β-oxidation, "β-Ox") as is shown in the systems depicted in FIGS. 5 and 6.

Although multiple, possible, cellular modifications are illustrated in FIG. 10, as described herein, some of the modifications depicted in the figure are optional enhancements of an exemplary engineered system and may or may not be included in a modified cell or organism depending on, for example, the intended use of the system (e.g., development of a particular single, or multiple, target molecule(s) production system) and the selection of variable features (e.g., host cell or organism, carbon source, regulatory controls (such as transcription control elements), culture conditions and the like) of the system. Thus, it is understood that any optional modifications set forth in the exemplary system shown in FIG. 10 are non-limiting and may or may not be included in a particular engineered system and, if included, may be in utilized in different combinations than illustrated in the figure.

Engineered Acetyl-CoA-Generating Pathways in a Platform Target Molecule Production System FIG. 11 depicts possible cellular modifications in some embodiments of a eukaryotic (i.e., yeast in this example) platform system for the enhanced generation of acetyl-CoA. Acetyl-CoA can be a versatile precursor molecule in the synthesis of many industrially valuable molecules. Accordingly, a system such as that depicted in FIG. 11 can be used as a platform for incorporating particular pathways for the production of a diverse array of target molecules. The cell-based platform system shown in FIG. 11 can incorporate carbon-flux modifications shown in FIG. 8 that are designed to capture carbon atoms as acetyl-CoA in the cytosol by enhancing carbon flow through cellular oxidative metabolism pathways (ω-oxidation and peroxisomal β-oxidation) and reducing flow of carbon into mitochondria. FIG. 11 differs from FIG. 8 in that it shows an embodiment of the platform system in which target molecule production pathways extend from acetyl-CoA, instead of malonyl-CoA, as a precursor molecule. The core of this platform system, as it is for the system shown in FIG. 8, centers on acetyl group diversion elements that can impede the flow of acetyl group carbons into mitochondria and can enhance flow of the carbons into generation of acetyl-CoA. In systems designed for production of target molecules using acetyl-CoA as a precursor, these elements can optionally be combined with a carbon recycle loop that captures any cytosolic acetyl moieties that are not funneled into the target molecule production pathway into cytosolic fatty acid synthesis to regenerate an acyl-CoA that can be diverted from lipid synthesis and converted into a fatty acid that can be subjected to another cycle of peroxisomal β-oxidation.

FIG. 11 shows an embodiment of a platform system for the enhanced generation of acetyl-CoA in connection with terpene target molecule production as an example of the use of acetyl-CoA as a precursor molecule. As shown in the figure, terpenes can be generated, for example, from isopentenyl diphosphate produced through mevalonate pathways in cells. Through a series of reactions in the mevalonate pathway present in eukaryotes and some bacteria, acetyl-CoA can be converted to isopentenyl diphosphate (IPP) and dimethylallyl diphosphate (DMAPP) which are precursors in the production of polyisoprenoids (e.g., dolichol) and sterols (e.g., ergosterol, cholesterol). Terpenes, e.g., valencene, lycopene, carotenes and the like, can be produced from IPP through further reactions involving enzymes such as, for example, valencene synthase, and enzymes encoded by carotenoid biosynthesis CRT genes (e.g., geranylgeranyl pyrophosphate synthase (CrtE), phytoene synthase (CrtB), phytoene desaturase (CrtI), beta-carotene ketolase (CrtW), beta-carotene hydroxylase (CrtZ)). Cells and organisms engineered for production of terpenes as shown in FIG. 11 can be modified to enhance flow of carbon through the terpene production pathways. For example, such engineered cells can be genetically modified to express, or increase expression of, any of the mevalonate pathway enzymes and/or enzymes involved in terpene synthesis pathways.

As set forth in connection with the description of the platform systems shown in FIGS. 5 and 8, carbon flux alteration in the system shown in FIG. 11 can begin with modifications (e.g., decreased acyl-CoA synthetase (Faa1 and/or Fat1) activity) that can enhance carbon flow in the form of a fatty acid (from, for example, a fatty acid carbon source or derived from an alkane source) into ω- and β-oxidation pathways in the cell or organism. The oxidative metabolism aspect of the platform system can be further enhanced through modification of ω- and/or β-oxidation activity as described herein. Carbon capture modifications of this platform system, as in the system depicted in FIGS. 5 and 8, can occur in the processing of the acetyl-CoA generated during β-oxidation and can include diversion elements that can impede the flow of acetyl group carbons into mitochondria (e.g., decreasing mitochondrial carnitine transporters and carnitine acetyltransferase activities) and enhance flow of the carbons into generation of acetyl-CoA (e.g., increasing cytosolic carnitine acetyltransferase activity). At this point in the platform pathway system depicted in FIG. 11, when acetyl moieties are accumulated in the cytosol as acetyl-CoA, there primarily are two pathways in which they can be used: (1) fatty acid synthesis (FAS) through initial conversion into malonyl-CoA and (2) target molecule synthesis pathways that can be engineered into the host cell or organism. Thus, target molecule synthesis can be limited by competition for the acetyl-CoA substrate by the FAS pathway. To minimize this competition, in this platform system, unlike the systems shown in FIGS. 5 and 8, the host cell or organism is not modified to increase acetyl-CoA carboxylase activity, which is an enzyme that catalyzes conversion of acetyl-CoA into malonyl-CoA and can commit it to fatty acid synthesis.

However, if an acetyl-CoA carboxylase activity is present in the cytosol of this cellular system, and the system includes a functional FAS pathway, any acetyl-CoA molecules that are lost to the fatty acid synthesis pathway can be recaptured for possible use in target molecule synthesis by including an optional carbon recycling loop (such as that described in reference to FIG. 5) in the system. The final product of cytosolic fatty acid synthesis is typically an acyl-CoA (e.g., palmitoyl-CoA), which is shown as "FA-CoA" in FIG. 11. To avoid loss of the carbon atoms in the acyl-CoA lipid synthesis pathways, and complete the carbon recycling loop, the host cell or organism can optionally be modified to include a cytosolic thioesterase enzyme to, in effect, "deactivate" the fatty acid-CoA through hydrolysis and removal of coenzyme A. This can divert the carbons in the acyl-CoA from use in cellular processes not involved in target molecule production and/or generation of cytosolic acetyl-CoA and can complete the recycling loop by generating a cytosolic free fatty acid that can then begin a new cycle of the loop pathway at the initial point of ω-oxidation. As described herein, a host cell can be modified to increase (or introduce) a thioesterase activity (shown as TES3$^{cyt}$ in a diagonal line-hatched background oval in FIG. 11) in the cytosol in order to direct acyl-CoA carbon flux toward oxidative metabolism pathways (ω- and β-oxidation).

The system depicted in FIG. 11 can serve as a platform that can be used in multiple ways. For example, as shown, the pathway can serve as an enhanced, high-efficiency cytosolic acetyl-CoA-generating system that can be further modified for use in generating a target molecule (e.g., terpenes) in an engineered pathway that initiates with an acetyl-CoA precursor. Additionally, the system depicted in FIG. 11 can be used in the co-production of a fatty dicarboxylic acid, e.g., adipic acid, and a target molecule generated using acetyl-CoA as a precursor in the synthesis pathway. In embodiments in which the system is used for co-production of a fatty diacid and another target molecule, the host cell or organism can optionally also be modified as described herein to decrease the amount and/or activity of, or eliminate, mechanisms for the transport of acyl-CoA across the peroxisomal membrane and into peroxisomes (e.g., shown as "pxa1Δ" in a black background oval in FIG. 11). This modification avoids the by-passing of ω-oxidation by acyl-CoA generated from fatty acid synthesis which would allow the formation of monocarboxlic acids.

Cells or organisms that have been modified to incorporate a biological platform system such as that depicted in FIG. 11 can be further modified depending on the purpose(s) for which the system is being used. For example, if the system is being used solely for the production of one or more target molecules synthesized from an acetyl-CoA precursor (i.e., not being used as a fatty acid co-production system), then it may be beneficial to modify the cell or organism to decrease or slow cytosolic fatty acid synthesis. The fatty acid synthesis (FAS) pathway in host cells or organisms can compete with any pathways for target molecule synthesis for the cytosolic acetyl-CoA produced in this platform system. Therefore, to enhance acetyl-CoA carbon atom flux toward target molecule synthesis and direct carbon flux away from fatty acid biosynthesis, a host cell or organism can optionally be modified to decrease or attenuate activity of one or more enzymes involved in fatty acid synthesis. Flux of acetyl-CoA carbon into the mevalonate pathway may also optionally be enhanced by increasing one or more activities of the mevalonate pathway. For example, a mevalonate pathway activity may be enhanced by genetically modifying an enzyme that catalyzes a reaction in the pathway (e.g., increasing the copy number of nucleic acids encoding a mevalonate pathway enzyme in the cell, increasing the transcription of such nucleic acids and/or introducing nucleic acid encoding a more active enzyme into the cell).

If a platform system such as that depicted in FIG. 11 is being used for co-production of a fatty dicarboxylic acid and a target product derived from another pathway using acetyl-CoA precursors (e.g., the mevalonate pathway), then it may be beneficial to either make no modifications of the FAS pathway activities or modify the host cell or organism to increase the amount, activity, and/or alter the specificity, of enzymes in the fatty acid synthesis (FAS) enzyme complex, shown as "FAS" in FIG. 11 (e.g., the enzyme activities of the FAS1 and FAS2 subunits of yeast). A system such as that shown in FIG. 11 being used for co-production of a fatty dicarboxylic acid and other acetyl-CoA-derived product could also optionally include modifications, such as those described herein, of one or more activities of the ω- and/or β-oxidation pathways to enhance production of a desired dicarboxylic acid as described herein (e.g., modification of acyl-CoA oxidases, such as Pox4 and Pox5, monooxygenase, cytochrome P450 reductase). Such a co-production system would be depicted in FIG. 11 as including another arrow extending from a dicarboxylic acid (DCA-CoA) in the peroxisome to an acyl-CoA and then to a chain-shortened diacid (as a result of β-oxidation, "β-Ox") as is shown in the systems depicted in FIGS. 5 and 6.

Although multiple, possible, cellular modifications are illustrated in FIG. 11, as described herein, some of the modifications depicted in the figure are optional enhancements of an exemplary engineered system and may or may not be included in a modified cell or organism depending on, for example, the intended use of the system (e.g., development of a particular single, or multiple, target molecule(s) production system) and the selection of variable features (e.g., host cell or organism, carbon source, regulatory controls (such as transcription control elements), culture conditions and the like) of the system. Thus, it is understood that any optional modifications set forth in the exemplary system shown in FIG. 11 are non-limiting and may or may not be included in a particular engineered system and, if included, may be in utilized in different combinations than illustrated in the figure.

Methods for Producing Target Molecules

Provided herein are methods for contacting an engineered cell, microorganism or organism with a carbon source (e.g., a feedstock containing fatty acids and/or alkanes) under conditions whereby one or more target molecules is produced. Biological methods provided herein for producing a target molecule can incorporate cells or organisms, such as those provided herein, that have been modified to enhance production efficiency by maximizing use and minimizing the costs of raw starting materials input into the process. The methods are designed to provide flexibility in culture conditions, particularly carbon source utilization, and coordinated regulatory mechanisms to enable efficient production of a variety of carbon-containing target molecules. In some embodiments of the methods, the cell or organism used for target molecule production is one that is able to assimilate a variety of carbon sources, including one or more non-fermentable (e.g., alkanes, fatty acids, alcohols) as well as fermentable carbon sources. In particular embodiments, the cell or organism is one that is able to survive under conditions in which the sole carbon source is a non-fermentable carbon source. The use of such cells and organisms in some embodiments of the production methods can contribute to the cost-effectiveness and environmental soundness of the methods.

In certain embodiments, a cell or organism used in the production methods has been modified to alter cellular carbon flux, including, for example, cells and organisms provided herein. Such carbon flux alterations include those that can increase the amount of the source carbon that is available for use in target molecule generation pathways. For example, one or more activities in one or more metabolic pathways of the cell or organism can be engineered to increase carbon flux through the pathways to produce a desired product. The engineered activities can be chosen such that there is an increased production of metabolic intermediates that can be utilized in one or more pathways to achieve increased production of a desired product relative to the unmodified host cell or organism. The engineered activities also can be chosen such that there is a decreased activity of enzymes that reduce production of a desired intermediate or end product (e.g., reverse activities).

This cellular carbon flux management can be optimized, for any chosen feedstock used in culturing the cells or organisms, by engineering the appropriate activities in the appropriate pathways. Non-limiting examples are given herein using pure alkanes (e.g., single chain length alkanes, dodecane for example), mixed chain-length alkanes, long-chain alkanes, pure fatty acids (e.g., single chain length fatty acids, capric acid or oleic acid for example) and mixed chain length fatty acids as a carbon source in a feedstock. The process of carbon flux management through engineered pathways can be used to produce a target molecule (e.g., an organic acid, a fatty acid, dicarboxylic acid, polyketide, terpene) at a level and/or rate closer to the calculated maximum theoretical yield for any given feedstock, than does a production process that has not been enhanced or modified using methods described herein. The terms "theoretical yield" or "maximum theoretical yield" as used herein refer to the yield of product of a chemical or biological reaction that can be formed if the reaction went to completion. Theoretical yield is based on the stoichiometry of the reaction and ideal conditions in which starting material is completely consumed, undesired side reactions do not occur, the reverse reaction does not occur, and there are no losses in the work-up procedure.

Growth Conditions and Fermentation

Large-scale cell- or microbial-based target molecule production is generally conducted by culturing the cells or organisms in a fermentor. The culture conditions can vary depending on the cell or organism and the target molecule being produced. In some embodiments of the production processes provided herein, the modified cell or organism is eukaryotic, such as, for example, a yeast. In particular embodiments, the yeast is one that is able to assimilate fatty acids and/or alkanes. For example, in some embodiments, the yeast is a species of *Candida*, e.g., *C. tropicalis* or *C. viswanathii* (e.g., ATCC 20336, ATCC 20913, ATCC 20962) or *Yarrowia*, e.g., *Y. lipolytica* (e.g., ATCC 20228). In some embodiments, the yeast is a thermotolerant yeast, e.g., a species of *Blastobotrys*, such as *Blastobotrys adeninivorans*. In some embodiments, the yeast is a non-oleaginous yeast. Engineered organisms often are cultured under conditions that optimize yield of a target molecule. For example, culture conditions can be selected to balance the levels of one or more of the following activities in order to optimize target molecule yield: carnitine acetyltransferase, acetylcarnitine translocase, acetyl-CoA carboxylase, ATP citrate lyase, acetyl-CoA hydrolase, acetyl-CoA synthetase, thioesterase, acyl-CoA synthetase, monooxygenase, cytochrome P450 reductase, alcohol dehydrogenase, alcohol oxidase, aldehyde dehydrogenase, acyl-CoA oxidase, 3-ketoacyl-CoA thiolase, peroxisomal transporter, peroxisome biogenesis factor, fatty acid synthase activity and multifunctional enzyme (e.g., enoyl-CoA hydratase and 3-hydroxyacyl-CoA dehydrogenase) activities. In general, non-limiting examples of conditions that may be optimized include the type and amount of carbon source, the type and amount of nitrogen source, the carbon-to-nitrogen ratio, the oxygen level, growth temperature, pH, length of the biomass production phase, length of target product accumulation phase, and time of cell harvest.

A suitable pH range for fermentation often is between about pH 4.0 to about pH 8.0, where a pH in the range of about pH 5.5 to about pH 7.0 sometimes is utilized for initial culture conditions. Depending on the host cell or organism, culturing may be conducted under aerobic or anaerobic conditions, where microaerobic conditions sometimes are maintained. In embodiments in which a *Candida* yeast (e.g., *C. tropicalis* or *C. viswanathii*) is used as the host microorganism, aerobic conditions can be optimal. A two-stage process may be utilized, where one stage promotes organism proliferation and another stage promotes production of target molecule. Suitable temperatures for culturing microorganisms generally are in the range of 28° C. to 35° C. However, some organisms are able to survive and grow in more extreme temperatures. Thermotolerant and/or osmotolerant organisms can be well suited for use in industrial production systems operating at elevated temperatures and/or osmotic pressures that would impair growth and/or metabolism and/or completely inactivate organisms that are not thermotolerant and/or osmotolerant. In some instances, production efficiency can be improved and production costs reduced in using such organisms due to decreases in losses and avoidance of implementation of cooling processes. Nitrogen may be supplied from an inorganic (e.g., $(NH_4)_2SO_4$) or organic source (e.g., urea or glutamate). In addition to appropriate carbon and nitrogen sources, culture media also can contain suitable minerals, salts, cofactors, buffers, vitamins, metal ions (e.g., $Mn^{+2}$, $Co^{+2}$, $Zn^{+2}$, $Mg^{+2}$) and other components suitable for culture of microorganisms.

Engineered microorganisms sometimes are cultured in complex media (e.g., yeast extract-peptone-dextrose broth (YPD)). In some embodiments, engineered microorganisms are cultured in a defined minimal media that lacks a component necessary for growth and thereby forces selection of a desired expression cassette (e.g., Yeast Nitrogen Base (DIFCO Laboratories, Detroit, Mich.)). Culture media in some embodiments are common commercially prepared media, such as Yeast Nitrogen Base (DIFCO Laboratories, Detroit, Mich.). Other defined or synthetic growth media may also be used. In specific embodiments, yeast are cultured in YPD media (10 g/L Bacto Yeast Extract, 20 g/L Bacto Peptone, and 20 g/L Dextrose). Filamentous fungi, in particular embodiments, can be grown in CM (Complete Medium) containing 10 g/L Dextrose, 2 g/L Bacto Peptone, 1 g/L Bacto Yeast Extract, 1 g/L Casamino acids, 50 mL/L 20× Nitrate Salts (120 g/L $NaNO_3$, 10.4 g/L KCl, 10.4 g/L $MgSO_4·7H_2O$), 1 mL/L 1000× Trace Elements (22 g/L $ZnSO_4·7H_2O$, 11 g/L $H_3BO_3$, 5 g/L $MnCl_2·7H_2O$, 5 g/L $FeSO_4·7H_2O$, 1.7 g/L $CoCl_2·6H_2O$, 1.6 g/L $CuSO_4·5H_2O$, 1.5 g/L $Na_2MoO_4·2H_2O$, and 50 g/L $Na_4EDTA$), and 1 mL/L Vitamin Solution (100 mg each of Biotin, pyridoxine, thiamine, riboflavin, p-aminobenzoic acid, and nicotinic acid in 100 mL water).

A variety of fermentation processes may be applied for commercial biological production of a target product. In some embodiments, commercial production of a target product from a recombinant microbial host is conducted using a batch, fed-batch or continuous fermentation process, for example. A batch fermentation process often is a closed system where the media composition is fixed at the beginning of the process and not subject to further additions beyond those required for maintenance of pH and oxygen level during the process. At the beginning of the culturing process the media is inoculated with the desired organism and growth or metabolic activity is permitted to occur without adding additional sources (i.e., carbon and nitrogen sources) to the medium. In batch processes the metabolite and biomass compositions of the system change constantly up to the time the culture is terminated. In a typical batch process, cells proceed through a static lag phase to a high-growth log phase and finally to a stationary phase, where the growth rate is diminished or halted. Left untreated, cells in the stationary phase will eventually die.

A variation of the standard batch process is the fed-batch process, where the carbon source is continually added to the fermenter over the course of the fermentation process. Fed-batch processes are useful when catabolite repression is apt to inhibit the metabolism of the cells or where it is desirable to have limited amounts of carbon source in the media at any one time. Measurement of the carbon source concentration in fed-batch systems may be estimated on the basis of the changes of measurable factors such as pH, dissolved oxygen and the partial pressure of waste gases (e.g., $CO_2$). Batch and fed-batch culturing methods are known in the art. Examples of such methods may be found in Thomas D. Brock in Biotechnology: A Textbook of Industrial Microbiology, 2.sup.nd ed., (1989) Sinauer Associates Sunderland, Mass. and Deshpande, Mukund V., *Appl. Biochem. Biotechnol.* 36:227 (1992).

In a continuous fermentation process, a defined media often is continuously added to a bioreactor while an equal amount of culture volume is removed simultaneously for product recovery. Continuous cultures generally maintain cells in the log phase of growth at a constant cell density. Continuous or semi-continuous culture methods permit the modulation of one factor or any number of factors that affect cell growth or end product concentration. For example, an approach may limit the carbon source and allow all other parameters to moderate metabolism. In some systems, a number of factors affecting growth may be altered continuously while the cell concentration, measured by media turbidity, is kept constant. Continuous systems often maintain steady state growth and thus the cell growth rate often is balanced against cell loss due to media being drawn off the culture. Methods of modulating nutrients and growth factors for continuous culture processes, as well as techniques for maximizing the rate of product formation, are known and a variety of methods are detailed by Brock, supra.

A non-limiting exemplary fermentation protocol, which includes an initial batch growth phase followed by a fed-batch production, or conversion, phase, that can be used for production of target molecules using modified yeast strains, such as some of those provided herein, is as follows. Fermentation medium of composition 14.0 g/L ammonium sulfate, 10.2 g/L potassium phosphate monobasic, 1.0 g/L magnesium sulfate, 0.2 g/L calcium chloride, 120 mg/L citric acid, 46 mg/L ferric chloride, 0.4 mg/L biotin, 54 g/L glucose and 2× trace metals mix is filter sterilized and transferred to a sterile fermentation vessel. Growth of a yeast strain, e.g., *Candida viswanathii*, is initiated with a 5% inoculum (initial OD600 nm=1.0) and growth conditions of 35° C., 1000 rpm, 1 vvm, pH 5.8 and initial volume of 1.0 L. Growth continues for approximately 15 hours before exhaustion of the initial carbon source. The temperature control is changed to 30° C. and the conversion phase is initiated by the addition of oleic acid to 5 g/L.

At the same time as the oleic acid bolus, a continuous feed of oleic acid is initiated at a rate of 1.5 g/L-h. Fermentation conditions are maintained at 30° C., 1000 rpm, 1 vvm, and pH 5.8 for 24 hours at which point the pH set-point is changed to 3.5. The fermentation is carried out for a total of about 135 hours. Samples are collected for GC analysis every 24 hours after initiating the conversion phase. In this protocol, cells are allowed to grow on glucose as a carbon source in the initial phase (i.e., growth phase) until the glucose is depleted. At this point, a different carbon source, e.g., a fatty acid such as oleic acid, is introduced into the fermentor (i.e., the conversion phase). This new carbon source is continuously fed into the fermentor to initiate and maintain target molecule production (i.e., production phase) that involves oxidative metabolic pathways (e.g., ω-oxidation and β-oxidation) and fatty acid-induced enzyme expression.

Feedstocks, Media, Supplements and Additives

Culture media generally contain a suitable carbon source. Carbon sources useful for culturing cells, microorganisms and/or fermentation processes sometimes are referred to as feedstocks. The term "feedstock" as used herein refers to a composition containing a carbon source that is provided to a cell or organism, which is used by the cell or organism to produce energy and metabolic products useful for growth. A feedstock may be a natural substance, a "man-made substance," a purified or isolated substance, a mixture of purified substances, a mixture of unpurified substances or combinations thereof. A feedstock often is prepared by and/or provided to a cell or organism by a person, and a feedstock often is formulated prior to administration to the cell or organism. A carbon source may include, but is not limited to including, one or more of the following substances: monosaccharides (e.g., also referred to as "saccharides," which include 6-carbon sugars (e.g., glucose, fructose), 5-carbon sugars (e.g., xylose and other pentoses) and the like), disaccharides (e.g., lactose, sucrose), oligosaccharides (e.g., glycans, homopolymers of a monosaccharide), polysaccharides (e.g., starch, cellulose, heteropolymers of monosaccharides or mixtures thereof), sugar alcohols (e.g., glycerol), and renewable feedstocks (e.g., cheese whey permeate, cornsteep liquor, sugar beet molasses, barley malt).

A carbon source also may include a metabolic product that can be used directly as a metabolic substrate in an engineered pathway described herein, or indirectly via conversion to a different molecule using engineered or native biosynthetic pathways in an engineered cell or microorganism. In some embodiments, a carbon source may include glycerol backbones generated by the action of an engineered pathway including at least a lipase activity. In certain embodiments, metabolic pathways can be preferentially biased towards production of a desired product by increasing the levels of one or more activities in one or more metabolic pathways having and/or generating at least one common metabolic and/or synthetic substrate. In some embodiments, a metabolic byproduct (e.g., glycerol) of an engineered activity (e.g., lipase activity) can be used in one or more metabolic pathways such as gluconeogenesis, pentose phosphate pathway, glycolysis, fatty acid synthesis, beta oxidation, and omega oxidation, to generate a carbon source that can be converted to a target molecule, e.g., adipic acid.

In some embodiments, a feedstock includes a mixture of carbon sources, where each carbon source in the feedstock is selected based on the genotype of the cultured cell or organism. In certain embodiments, a mixed carbon source feedstock includes one or more carbon sources selected from sugars, cellulose, fatty acids, triacylglycerides, paraffins, the like and combinations thereof.

In some embodiments a feedstock is selected according to the genotype and/or phenotype of the cell or organism that is cultured. For example, as described herein, for the production of certain target molecules (e.g., dicarboxylic acids of a particular carbon chain length) the activities of oxidative processes, such as β-oxidation, can be altered through genetic modification of a host cell or organism. In some instances, the catalytic activities and/or substrate specificities of, for example, one or more acyl-CoA oxidases of the host cell β-oxidation pathway can be modified in order to ensure that carbon sources of a particular chain length are or are not subject to degradation. The feedstock used in target molecule production by such modified cells or organisms can be selected to enhance the production process. For example, a feedstock rich in 12-carbon fatty acids, 12-carbon dicarboxylic acids or 12-carbon paraffins, or a mixture of 10, 12 and 14-carbon compounds can be useful for culturing yeast strains harboring an alteration that partially blocks beta oxidation by disrupting POX4 activity, as described herein. Non-limiting examples of carbon sources having 10 to 14 carbons include fats (e.g., coconut oil, palm kernel oil), paraffins (e.g., alkanes, alkenes, or alkynes) having 10 to 14 carbons, (e.g., dodecane (also referred to as adakane12, bihexyl, dihexyl and duodecane); tetradecane), alkene and alkyne derivatives), fatty acids (decanoic, dodecanoic acid, tetradecanoic acid), fatty alcohols (decanol, dodecanol, tetradecanol), the like, non-toxic substituted derivatives or combinations thereof.

In certain embodiments involving genetically modified cells or organisms having partially blocked beta-oxidation pathways, feedstocks suitable for use include, but are not limited to, fatty acid distillates or soapstocks of renewable oils (palm oil fatty acid distillate, soybean oil soapstock, coconut oil soapstock), renewable oils (coconut oil, palm oil, palm kernel oil, soybean oil, corn oil, and the like), fatty acids of chain length equal to or greater than C10 (in substantially single form (e.g., in substantially pure form) or in mixture form, alkanes of chain length equal to or greater than C10 in substantially single form (e.g., substantially pure form) or in mixture form. Any suitable alkane, fatty acid, fatty alcohol, plant based oil, seed based oil, non-petroleum derived soap stock or the like can be used as the feedstock for the cell or organism (e.g., dodecane, methyl laurate, lauric acid, carbon sources having 10 or greater carbons (e.g. for sebacic acid production) or carbon sources having 12 or greater carbons (e.g. for dodecanedioic acid production)). In some embodiments, carbon sources with greater than 12 carbons can be metabolized using naturally occurring and/or engineered pathways to yield molecules that can be further metabolized using the beta oxidation pathway.

In some embodiments, one acyl-CoA oxidase activity of the beta-oxidation pathway of a host cell or organism is engineered such that it is enhanced, and in certain embodiments, another acyl-CoA oxidase activity in the beta-oxidation pathway is altered to reduce or eliminate the activity, thereby optimizing the production of a diacid of a desired chain-length or diacids with a distribution of desired chain lengths. In some embodiments, an acyl-CoA oxidase is selected and/or engineered to alter the substrate specificity of the enzyme. In certain embodiments, the substrate specificity of a heterologous and/or engineered acyl-CoA oxidase is for carbon chain lengths of between about 12 carbons and about 18 carbons, and in some embodiments a heterologous and/or engineered acyl-CoA oxidase exhibits no activity on substrates below 12 carbons in length. In certain embodiments, a heterologous acyl-CoA oxidase with a desired chain length specificity can be isolated from any suitable organism. In certain embodiments, a carbon source starting material (e.g., alkane, fatty acid, fatty alcohol, dicarboxylic acid) of intermediate or long chain length (e.g., between about 10 carbons and 22 carbons) is converted into an acyl-CoA derivative for entry into the beta-oxidation pathway. A fatty acid can be processed using omega oxidation to yield a dicarboxylic acid (e.g., dodecanedioic acid).

Examples of Carbon Sources

A carbon source may include, but is not limited to including, one or more of the following substances: alkanes, alkenes, mono-carboxylic acids, di-carboxylic acids, monosaccharides (e.g., also referred to as "saccharides," which include 6-carbon sugars (e.g., glucose, fructose), 5-carbon sugars (e.g., xylose and other pentoses) and the like), disaccharides (e.g., lactose, sucrose), oligosaccharides (e.g., glycans, homopolymers of a monosaccharide), polysaccharides (e.g., starch, cellulose, heteropolymers of monosaccharides or mixtures thereof), sugar alcohols (e.g., glycerol), and renewable feedstocks (e.g., cheese whey permeate, cornsteep liquor, sugar beet molasses, barley malt).

Carbon sources also can be selected from one or more of the following non-limiting examples: paraffin (e.g., saturated paraffin, unsaturated paraffin, substituted paraffin, linear paraffin, branched paraffin, or combinations thereof); alkanes (e.g., hexane, dodecane), alkenes or alkynes, each of which may be linear, branched, saturated, unsaturated, substituted or combinations thereof (described in greater herein); linear or branched alcohols (e.g., hexanol, dodecanol); saturated or unsaturated fatty acids (e.g., each fatty acid is about 1 carbon to about 60 carbons with 0 to 10 unsaturations, including free fatty acids, mixed fatty acids, single fatty acid, purified fatty acids (e.g., single fatty acid or mixture of fatty acids), fatty acid distillates, soap stocks, the like and combinations thereof); esters of fatty acids; salts of fatty acids, monoglycerides; diglycerides; triglycerides, phospholipids. Non-limiting commercial sources of products for preparing feedstocks include plants, plant oils or plant products (e.g., vegetable oils (e.g., almond oil, canola oil, cocoa butter, coconut oil, corn oil, cottonseed oil, flaxseed oil, grape seed oil, illipe, jatropha oil, olive oil, palm oil, palm olein, palm kernel oil, rapeseed oil, safflower oil, peanut oil, soybean oil, sesame oil, shea nut oil, sunflower oil, walnut oil, the like and combinations thereof) and vegetable oil products), purified fatty acids (e.g., myristoleic acid, palmitoleic acid, sapienic acid, oleic acid, elaidic acid, vaccenic acid, linoleic acid, linoelaidic acid, α-linolenic acid, arachidonic acid, eicosapentaenoic acid, erucic acid and docosahexaenoic acid) and animal fats (e.g., beef tallow, butterfat, lard, cod liver oil). A carbon source may include a petroleum product and/or a petroleum distillate (e.g., diesel, fuel oils, gasoline, kerosene, paraffin wax, paraffin oil, petrochemicals). In some embodiments, a feedstock comprises petroleum distillate. A carbon source can be a fatty acid distillate (e.g., a palm oil distillate or corn oil distillate). Fatty acid distillates can be by-products from the refining of crude plant oils. In some embodiments, a feedstock comprises a fatty acid distillate.

In some embodiments, a feedstock comprises a soapstock (i.e. soap stock). A widely practiced method for purifying crude vegetable oils for edible use is the alkali or caustic refining method. This process employs a dilute aqueous solution of caustic soda to react with the free fatty acids present which results in the formation of soaps. The soaps together with hydrated phosphatides, gums and prooxidant metals are typically separated from the refined oil as the heavy phase discharge from the refining centrifuge and are typically known as soapstock.

A carbon source also may include a metabolic product that can be used directly as a metabolic substrate in an engineered pathway described herein, or indirectly via conversion to a different molecule using engineered or native biosynthetic pathways in an engineered cell or microorganism. In some embodiments, a carbon source may include glycerol backbones generated by the action of an engineered pathway including at least a lipase activity. In certain embodiments, metabolic pathways can be preferentially biased towards production of a desired product by increasing the levels of one or more activities in one or more metabolic pathways having and/or generating at least one common metabolic and/or synthetic substrate. In some embodiments, a metabolic byproduct (e.g., fatty acid, glycerol) of an engineered activity (e.g., ω-oxidation activity, lipase activity) can be used in one or more metabolic pathways, such as gluconeogenesis, pentose phosphate pathway, glycolysis, fatty acid synthesis, beta oxidation, and omega oxidation, to generate a carbon source that can be converted to a fatty dicarboxylic acid (e.g., adipic acid, octanedioic acid, decanedioic acid, dodecanedioic acid, tetradecanedioic acid, hexadecanedioic acid, octadecanedioic acid, eicosanedioic acid) or other target molecule.

A carbon source can be an organic acid, including, but not limited to, fatty acids, diacids and β-hydroxy acids (e.g., hydroxyalkanoate monomers). As used herein, "organic acid" and "fatty acid" encompass the free-acid forms thereof and salts or esters thereof. Fatty acids are aliphatic acids of varying carbon chain lengths. Fatty acids generally have a formula that includes: R1-COOR2. In some embodiments, R1 can be an aliphatic group, and can include 1 to 30 carbon atoms, or 6 to 24 carbon atoms, and R2 can be hydrogen, methyl, ethyl, propyl or butyl. For example, R1 can include about 1 carbon atom, about 2 carbon atoms, about 3 carbon atoms, about 4 carbon atoms, about 5 carbon atoms, about 6 carbon atoms, about 7 carbon atoms, about 8 carbon atoms, about 9 carbon atoms, about 10 carbon atoms, about 12 carbon atoms, about 14 carbon atoms, about 16 carbon atoms, about 18 carbon atoms, about 20 carbon atoms, about 22 carbon atoms, about 24 carbon atoms, about 26 carbon atoms, about 28 carbon atoms or about 30 carbon atoms. Naturally occurring fatty acids in biological systems generally contain an even number of carbon atoms, typically between about 12 to about 24, or about 14 to about 24, and most commonly, 16 or 18 carbon atoms. Based on the number of carbons in a fatty acid carbon chain, it can be categorized as a short-, medium- or long-chain fatty acid. Generally, short-chain fatty acids have a chain length of about 2 to about 6 carbon atoms, medium-chain fatty acids have a chain length of about 8 to about 10 carbon atoms, long-chain fatty acids have a chain length of about 12 to about 20 carbon atoms and very long-chain length fatty acids have a chain length of about 22 or about 24 or more carbon atoms. The carbon atom bonds in the alkyl chain may all be single bonds (i.e., a saturated fatty acid) or may contain one or more double bonds (i.e., an unsaturated fatty acid). Unsaturated fatty acids having one double bond are also referred to as monoenoic; unsaturated fatty acids having two or more double bonds in the carbon chain are also referred to as polyenoic and polyunsaturated (PUFA). The carbon chain in a fatty acid may also be substituted with hydroxyl, methyl, or other groups in place of a hydrogen. Carboxylic acids, such as fatty acids, can partially dissociate in aqueous media and exist as undissociated, uncharged molecules and as a dissociated, anionic form.

Fatty acids containing one carboxyl group can also be referred to as monocarboxylic fatty acids. A fatty acid containing two carboxyl groups (e.g., α,ω-dicarboxylic acids) is a fatty dicarboxylic acid, also referred to herein as a diacid. Fatty dicarboxylic acids generally have a formula that includes: R1OOC—R—COOR2. In some embodiments, R can be an aliphatic group, and can include 1 to 30 carbon atoms, or 4 to 24 carbon atoms, and R1 and R2 can be hydrogen, methyl, ethyl, propyl or butyl. For example, R can include about 1 carbon atom, about 2 carbon atoms, about 3 carbon atoms, about 4 carbon atoms, about 5 carbon atoms, about 6 carbon atoms, about 7 carbon atoms, about 8 carbon atoms, about 9 carbon atoms, about 10 carbon atoms, about 12 carbon atoms, about 14 carbon atoms, about 16 carbon atoms, about 18 carbon atoms, about 20 carbon atoms, about 22 carbon atoms, about 24 carbon atoms, about 26 carbon atoms, about 28 carbon atoms or about 30 carbon atoms. An example of a diacid is adipic acid (hexanedioic acid) which contains six carbon atoms. A diacid sometimes is a C4 to a C24 diacid (i.e., a diacid containing 4 carbons to 24 carbons) and sometimes is a C8, C10, C12, C14, C16, C18, or C20 diacid. A hydrocarbon portion of a diacid sometimes is fully saturated and sometimes a diacid includes one or more unsaturations (e.g., double bonds). In some embodiments, genetically modified cells and organisms and processes provided herein are capable of producing a diacid.

Non-limiting examples of diacids include octadecanedioic acid, decanedioic acid, dodecanedioic acid, tetradecanedioic acid, hexadecanedioic acid, octadecanedioic acid, eicosanedioic acid and other organic intermediates. Non-limiting examples of fatty dicarboxylic acids include adipic acid (hexanedioic acid, 1,4-butanedicarboxylic acid), suberic acid (i.e., octanedioic acid, 1,8-octanedioic acid, octanedioic acid, octane-1,8-dioic acid, 1,6-hexanedicarboxylic acid, capryllic diacids), sebacic acid (i.e., 1,10-decanedioic acid, decanedioic acid, decane-1,10-dioic acid, 1,8-octanedicarboxylic acid, capric diacid), azelaic acid, undecanedioc acid, dodecanedioic acid (i.e., DDDA, 1,12-dodecanedioic acid, dodecanedioic acid, dodecane-1,12-dioic acid, 1,10-decanedicarboxylic acid, decamethylenedicaboxylic acid, 1,10-dicarboxydecane, lauric diacid), tetradecanedioic acid (i.e., TDDA, 1,14-tetradecanedioic acid, tetradecanedioic acid, tetradecane-1,14-dioic acid, 1,12-dodecanedicarboxylic acid, myristic diacid), thapsic acid (i.e., hexadecanedioic acid, 1,16-hexadecanedioic acid, hexadecanedioic acid, hexadecane-1,16-dioic acid, 1,14-tetradecanedicarboxylic acid, palmitic diacid), cis-9-hexadecenedioic acid (i.e., palmitoleic diacids), octanedioic acid (i.e., 1,18-octadecanedioic acid, octadecanedioic acid, octadecane-1,18-dioic acid, 1,16-hexadecanedicarboxylic acid, stearic diacid), cis-9-octadecenedioic acid (i.e., oleic diacids), cis-9,12-octadecenedioic acid (i.e., linoleic diacids), cis-9,12,15-octadecenedioic acid (i.e., linolenic diacids), arachidic diacid (i.e., eicosanoic diacid, icosanoic diacid), 11-eicosenoic diacid (i.e., cis-11-eicosenedioic acid), 13-eicosenoic diacids (i.e., cis-13-eicosenedioic acid), arachidonic diacid (i.e., cis-5,8,11,14-eicosatetraenedioic acid) and salts and esters of fatty acids, including, for example, any of the foregoing diacids.

The term "paraffin" as used herein refers to the common name for alkane hydrocarbons, independent of the source (e.g., plant derived, petroleum derived, chemically synthesized, fermented by a microorganism), or carbon chain length. A carbon source sometimes comprises a paraffin, and in some embodiments, a paraffin is predominant in a carbon source (e.g., about 75%, 80%, 85%, 90% or 95% paraffin). A paraffin sometimes is saturated (e.g., fully saturated), sometimes includes one or more unsaturations (e.g., about 1, 2, 3, 4, 5, 6, 7, 8, 9, 10 unsaturations) and sometimes is substituted with one or more non-hydrogen substituents. Non-limiting examples of non-hydrogen substituents include halo, acetyl, =O, =N—CN, =N—OR, =NR, OR, $NR_2$, SR, $SO_2R$, $SO_2NR_2$, $NRSO_2R$, $NRCONR_2$, NRCOOR, NRCOR, CN, COOR, $CONR_2$, OOCR, COR, and $NO_2$, where each R is independently H, C1-C8 alkyl, C2-C8 heteroalkyl, C1-C8 acyl, C2-C8 heteroacyl, C2-C8 alkenyl, C2-C8 heteroalkenyl, C2-C8 alkynyl, C2-C8 heteroalkynyl, C6-C10 aryl, or C5-C10 heteroaryl, and each R is optionally substituted with halo, =O, =N—CN, =N—OR', =NR', OR', $NR'_2$, SR', $SO_2R'$, $SO_2NR'_2$, $NR'SO_2R'$, $NR'CONR'_2$, NR'COOR', NR'COR', CN, COOR', $CONR'_2$, OOCR', COR', and $NO_2$, where each R' is independently H, C1-C8 alkyl, C2-C8 heteroalkyl, C1-C8 acyl, C2-C8 heteroacyl, C6-C10 aryl or C5-C10 heteroaryl.

A carbon source sometimes comprises an alkyl, alkenyl or alkynyl compound or molecule (e.g., a compound that includes an alkyl, alkenyl or alkynyl moiety (e.g., alkane, alkene, alkyne)). In certain embodiments, an alkyl, alkenyl or alkynyl molecule, or combination thereof, is predominant in a carbon source (e.g., about 75%, 80%, 85%, 90% or 95% of such molecules). As used herein, the terms "alkyl," "alkenyl" and "alkynyl" include straight-chain (referred to herein as "linear"), branched-chain (referred to herein as "non-linear"), cyclic monovalent hydrocarbyl radicals, and combinations of these, which contain only C and H atoms when they are unsubstituted. Non-limiting examples of alkyl moieties include methyl, ethyl, isobutyl, cyclohexyl, cyclopentylethyl, 2-propenyl, 3-butynyl, and the like. An alkyl that contains only C and H atoms and is unsubstituted sometimes is referred to as "saturated." An alkenyl or alkynyl generally is "unsaturated" as it contains one or more double bonds or triple bonds, respectively. An alkenyl can include any number of double bonds, such as 1, 2, 3, 4 or 5 double bonds, for example. An alkynyl can include any number of triple bonds, such as 1, 2, 3, 4 or 5 triple bonds, for example. Alkyl, alkenyl and alkynyl molecules sometimes contain between about 2 to about 60 carbon atoms (C). For example, an alkyl, alkenyl and alkynyl molecule can include about 1 carbon atom, about 2 carbon atoms, about 3 carbon atoms, about 4 carbon atoms, about 5 carbon atoms, about 6 carbon atoms, about 7 carbon atoms, about 8 carbon atoms, about 9 carbon atoms, about 10 carbon atoms, about 12 carbon atoms, about 14 carbon atoms, about 16 carbon atoms, about 18 carbon atoms, about 20 carbon atoms, about 22 carbon atoms, about 24 carbon atoms, about 26 carbon atoms, about 28 carbon atoms, about 30 carbon atoms, about 32 carbon atoms, about 34 carbon atoms, about 36 carbon atoms, about 38 carbon atoms, about 40 carbon atoms, about 42 carbon atoms, about 44 carbon atoms, about 46 carbon atoms, about 48 carbon atoms, about 50 carbon atoms, about 52 carbon atoms, about 54 carbon atoms, about 56 carbon atoms, about 58 carbon atoms or about 60 carbon atoms. In some embodiments, paraffins can have a mean number of carbon atoms of between about 8 to about 18 carbon atoms (e.g., about 8 carbon atoms, about 9 carbon atoms, about 10 carbon atoms, about 11 carbon atoms, about 12 carbon atoms, about 13 carbon atoms, about 14 carbon atoms, about 15 carbon atoms, about 16 carbon atoms, about 17 carbon atoms and about 18 carbon atoms). A single group can include more than one type of multiple bond, or more than one multiple bond. Such groups are included within the definition of the term "alkenyl" when they contain at least one carbon-carbon double bond, and are included within the term "alkynyl" when they contain at least one carbon-carbon triple bond. Alkyl, alkenyl and alkynyl molecules include molecules that comprise an alkyl, alkenyl and/or alkynyl moiety, and include molecules that consist of an alkyl, alkenyl or alkynyl moiety (i.e., alkane, alkene and alkyne molecules).

Alkyl, alkenyl and alkynyl substituents sometimes contain 1-20C (alkyl) or 2-20C (alkenyl or alkynyl). They can contain about 8-14C or about 10-14C in some embodiments. A single group can include more than one type of multiple bond, or more than one multiple bond. Such groups are included within the definition of the term "alkenyl" when they contain at least one carbon-carbon double bond, and are included within the term "alkynyl" when they contain at least one carbon-carbon triple bond.

Alkyl, alkenyl and alkynyl groups or compounds sometimes are substituted to the extent that such substitution can be synthesized and can exist. Typical substituents include, but are not limited to, halo, acetyl, =O, =N—CN, =N—OR, =NR, OR, $NR_2$, SR, $SO_2R$, $SO_2NR_2$, $NRSO_2R$, $NRCONR_2$, NRCOOR, NRCOR, CN, COOR, $CONR_2$, OOCR, COR, and $NO_2$, where each R is independently H, C1-C8 alkyl, C2-C8 heteroalkyl, C1-C8 acyl, C2-C8 heteroacyl, C2-C8 alkenyl, C2-C8 heteroalkenyl, C2-C8 alkynyl, C2-C8 heteroalkynyl, C6-C11 aryl, or C5-C11 heteroaryl, and each R is optionally substituted with halo, =O, =N—CN, =N—OR', =NR', OR', $NR'_2$, SR', $SO_2R'$, $SO_2NR'_2$, $NR'SO_2R'$, $NR'CONR'_2$, NR'COOR', NR'COR', CN, COOR', $CONR'_2$, OOCR', COR', and $NO_2$, where each R' is independently H, C1-C8 alkyl, C2-C8 heteroalkyl, C1-C8 acyl, C2-C8 heteroacyl, C6-C10 aryl or C5-C10 heteroaryl. Alkyl, alkenyl and alkynyl groups can also be substituted by C1-C8 acyl, C2-C8 heteroacyl, C6-C10 aryl or C5-C10 heteroaryl, each of which can be substituted by the substituents that are appropriate for the particular group.

"Acetylene" substituents are 2-10C alkynyl groups that are optionally substituted, and are of the formula —C≡C—Ri, where Ri is H or C1-C8 alkyl, C2-C8 heteroalkyl, C2-C8 alkenyl, C2-C8 heteroalkenyl, C2-C8 alkynyl, C2-C8 heteroalkynyl, C1-C8 acyl, C2-C8 heteroacyl, C6-C10 aryl, C5-C10 heteroaryl, C7-C12 arylalkyl, or C6-C12 heteroarylalkyl, and each Ri group is optionally substituted with one or more substituents selected from halo, =O, =N—CN, =N—OR', =NR', OR', NR'2, SR', $SO_2R'$, $SO_2NR'_2$, $NR'SO_2R'$, $NR'CONR'_2$, NR'COOR', NR'COR', CN, COOR', $CONR'_2$, OOCR', COR', and $NO_2$, where each R' is independently H, C1-C6 alkyl, C2-C6 heteroalkyl, C1-C6 acyl, C2-C6 heteroacyl, C6-C10 aryl, C5-C10 heteroaryl, C7-12 arylalkyl, or C6-12 heteroarylalkyl, each of which is optionally substituted with one or more groups selected from halo, C1-C4 alkyl, C1-C4 heteroalkyl, C1-C6 acyl, C1-C6 heteroacyl, hydroxy, amino, and =O; and where two R' can be linked to form a 3-7 membered ring optionally containing up to three heteroatoms selected from N, O and S. In some embodiments, Ri of —C≡C—Ri is H or Me.

A carbon source sometimes comprises a heteroalkyl, heteroalkenyl and/or heteroalkynyl molecule or compound (e.g., comprises heteroalkyl, heteroalkenyl and/or heteroalkynyl moiety (e.g., heteroalkane, heteroalkene or heteroalkyne)). "Heteroalkyl", "heteroalkenyl", and "heteroalkynyl" and the like are defined similarly to the corresponding hydrocarbyl (alkyl, alkenyl and alkynyl) groups, but the 'hetero' terms refer to groups that contain one to three O, S or N heteroatoms or combinations thereof within the backbone; thus at least one carbon atom of a corresponding alkyl, alkenyl, or alkynyl group is replaced by one of the specified heteroatoms to form a heteroalkyl, heteroalkenyl, or heteroalkynyl group. The typical and sizes for heteroforms of alkyl, alkenyl and alkynyl groups are generally the same as for the corresponding hydrocarbyl groups, and the substituents that may be present on the heteroforms are the same as those described above for the hydrocarbyl groups. For reasons of chemical stability, it is also understood that, unless otherwise specified, such groups do not include more than two contiguous heteroatoms except where an oxo group is present on N or S as in a nitro or sulfonyl group.

The term "alkyl" as used herein includes cycloalkyl and cycloalkylalkyl groups and compounds, the term "cycloalkyl" may be used herein to describe a carbocyclic non-aromatic compound or group that is connected via a ring carbon atom, and "cycloalkylalkyl" may be used to describe a carbocyclic non-aromatic compound or group that is connected to a molecule through an alkyl linker. Similarly, "heterocyclyl" may be used to describe a non-aromatic cyclic group that contains at least one heteroatom as a ring member and that is connected to the molecule via a ring atom, which may be C or N; and "heterocyclylalkyl" may be used to describe such a group that is connected to another molecule through a linker. The sizes and substituents that are suitable for the cycloalkyl, cycloalkylalkyl, heterocyclyl, and heterocyclylalkyl groups are the same as those described above for alkyl groups. As used herein, these terms also include rings that contain a double bond or two, as long as the ring is not aromatic.

A carbon source sometimes comprises an acyl compound or moiety (e.g., compound comprising an acyl moiety). As used herein, "acyl" encompasses groups comprising an alkyl, alkenyl, alkynyl, aryl or arylalkyl radical attached at one of the two available valence positions of a carbonyl carbon atom, and heteroacyl refers to the corresponding groups where at least one carbon other than the carbonyl carbon has been replaced by a heteroatom chosen from N, O and S. Thus heteroacyl includes, for example, —C(=O)OR and —C(=O)NR$_2$ as well as —C(=O)-heteroaryl.

Acyl and heteroacyl groups are bonded to any group or molecule to which they are attached through the open valence of the carbonyl carbon atom. Typically, they are C1-C8 acyl groups, which include formyl, acetyl, pivaloyl, and benzoyl, and C2-C8 heteroacyl groups, which include methoxyacetyl, ethoxycarbonyl, and 4-pyridinoyl. The hydrocarbyl groups, aryl groups, and heteroforms of such groups that comprise an acyl or heteroacyl group can be substituted with the substituents described herein as generally suitable for each of the corresponding component of the acyl or heteroacyl group.

A carbon source sometimes comprises one or more aromatic moieties and/or heteroaromatic moieties. "Aromatic" moiety or "aryl" moiety refers to a monocyclic or fused bicyclic moiety having the well-known characteristics of aromaticity; examples include phenyl and naphthyl. Similarly, "heteroaromatic" and "heteroaryl" refer to such monocyclic or fused bicyclic ring systems which contain as ring members one or more heteroatoms selected from O, S and N. The inclusion of a heteroatom permits aromaticity in 5 membered rings as well as 6 membered rings. Typical heteroaromatic systems include monocyclic C5-C6 aromatic groups such as pyridyl, pyrimidyl, pyrazinyl, thienyl, furanyl, pyrrolyl, pyrazolyl, thiazolyl, oxazolyl, and imidazolyl and the fused bicyclic moieties formed by fusing one of these monocyclic groups with a phenyl ring or with any of the heteroaromatic monocyclic groups to form a C8-C10 bicyclic group such as indolyl, benzimidazolyl, indazolyl, benzotriazolyl, isoquinolyl, quinolyl, benzothiazolyl, benzofuranyl, pyrazolopyridyl, quinazolinyl, quinoxalinyl, cinnolinyl, and the like. Any monocyclic or fused ring bicyclic system which has the characteristics of aromaticity in terms of electron distribution throughout the ring system is included in this definition. It also includes bicyclic groups where at least the ring which is directly attached to the remainder of the molecule has the characteristics of aromaticity. Typically, the ring systems contain 5-12 ring member atoms. The monocyclic heteroaryls sometimes contain 5-6 ring members, and the bicyclic heteroaryls sometimes contain 8-10 ring members.

Aryl and heteroaryl moieties may be substituted with a variety of substituents including C1-C8 alkyl, C2-C8 alkenyl, C2-C8 alkynyl, C5-C12 aryl, C1-C8 acyl, and heteroforms of these, each of which can itself be further substituted; other substituents for aryl and heteroaryl moieties include halo, OR, NR$_2$, SR, SO$_2$R, SO$_2$NR$_2$, NRSO$_2$R, NRCONR$_2$, NRCOOR, NRCOR, CN, COOR, CONR$_2$, OOCR, COR, and NO$_2$, where each R is independently H, C1-C8 alkyl, C2-C8 heteroalkyl, C2-C8 alkenyl, C2-C8 heteroalkenyl, C2-C8 alkynyl, C2-C8 heteroalkynyl, C6-C10 aryl, C5-C10 heteroaryl, C7-C12 arylalkyl, or C6-C12 heteroarylalkyl, and each R is optionally substituted as described above for alkyl groups. The substituent groups on an aryl or heteroaryl group may be further substituted with the groups described herein as suitable for each type of such substituents or for each component of the substituent. Thus, for example, an arylalkyl substituent may be substituted on the aryl portion with substituents typical for aryl groups, and it may be further substituted on the alkyl portion with substituents as typical or suitable for alkyl groups.

Similarly, "arylalkyl" and "heteroarylalkyl" refer to aromatic and heteroaromatic ring systems, which are stand-alone molecules (e.g., benzene or substituted benzene, pyridine or substituted pyridine), or which are bonded to an attachment point through a linking group such as an alkylene, including substituted or unsubstituted, saturated or unsaturated, cyclic or acyclic linkers. A linker often is C1-C8 alkyl or a hetero form thereof. These linkers also may include a carbonyl group, thus making them able to provide substituents as an acyl or heteroacyl moiety. An aryl or heteroaryl ring in an arylalkyl or heteroarylalkyl group may be substituted with the same substituents described above for aryl groups. An arylalkyl group sometimes includes a phenyl ring optionally substituted with the groups defined above for aryl groups and a C1-C4 alkylene that is unsubstituted or is substituted with one or two C1-C4 alkyl groups or heteroalkyl groups, where the alkyl or heteroalkyl groups can optionally cyclize to form a ring such as cyclopropane, dioxolane, or oxacyclopentane. Similarly, a heteroarylalkyl group often includes a C5-C6 monocyclic heteroaryl group optionally substituted with one or more of the groups described above as substituents typical on aryl groups and a C1-C4 alkylene that is unsubstituted. A heteroarylalkyl group sometimes is substituted with one or two C1-C4 alkyl groups or heteroalkyl groups, or includes an optionally substituted phenyl ring or C5-C6 monocyclic heteroaryl and a C1-C4 heteroalkylene that is unsubstituted or is substituted with one or two C1-C4 alkyl or heteroalkyl groups, where the alkyl or heteroalkyl groups can optionally cyclize to form a ring such as cyclopropane, dioxolane, or oxacyclopentane.

Where an arylalkyl or heteroarylalkyl group is described as optionally substituted, the substituents may be on the alkyl or heteroalkyl portion or on the aryl or heteroaryl portion of the group. The substituents optionally present on the alkyl or heteroalkyl portion sometimes are the same as those described above for alkyl groups, and the substituents optionally present on the aryl or heteroaryl portion often are the same as those described above for aryl groups generally.

"Arylalkyl" groups as used herein are hydrocarbyl groups if they are unsubstituted, and are described by the total number of carbon atoms in the ring and alkylene or similar linker. Thus a benzyl group is a C7-arylalkyl group, and phenylethyl is a C8-arylalkyl.

"Heteroarylalkyl" as described above refers to a moiety comprising an aryl group that is attached through a linking group, and differs from "arylalkyl" in that at least one ring atom of the aryl moiety or one atom in the linking group is a heteroatom selected from N, O and S. The heteroarylalkyl groups are described herein according to the total number of atoms in the ring and linker combined, and they include aryl groups linked through a heteroalkyl linker; heteroaryl groups linked through a hydrocarbyl linker such as an alkylene; and heteroaryl groups linked through a heteroalkyl linker. Thus, for example, C7-heteroarylalkyl includes pyridylmethyl, phenoxy, and N-pyrrolylmethoxy.

"Alkylene" as used herein refers to a divalent hydrocarbyl group. Because an alkylene is divalent, it can link two other groups together. An alkylene often is referred to as —$(CH_2)_n$— where n can be 1-20, 1-10, 1-8, or 1-4, though where specified, an alkylene can also be substituted by other groups, and can be of other lengths, and the open valences need not be at opposite ends of a chain. Thus —CH(Me)- and —C(Me)$_2$— may also be referred to as alkylenes, as can a cyclic group such as cyclopropan-1,1-diyl. Where an alkylene group is substituted, the substituents include those typically present on alkyl groups as described herein.

In certain embodiments, the feedstock contains a mixed set of aliphatic molecules from which diacids may be produced. In some embodiments, an aliphatic molecule in the feedstock is the predominant aliphatic species and sometimes a particular fatty acid produced from that aliphatic molecule is the predominant fatty acid species produced. A predominant species generally is 51% or more by weight of aliphatic molecule species in a feedstock or 51% or more by weight of diacid species in a product (e.g., about 55% or more, 60% or more, 65% or more, 70% or more, 75% or more, 80% or more, 85% or more, 90% or more or 95% or more).

Target Production, Isolation and Yield

Provided herein are methods for producing a target molecule or one or more target molecules. For example, in some embodiments, a method for producing one or more target molecules includes culturing a modified cell, microorganism or organism such as any of the modified cells and organisms described herein, under conditions in which the cell, organism or microorganism produces one or more target molecules. In some embodiments, a method for producing one or more target molecules includes contacting an engineered cell, organism, or microorganism with a carbon source (e.g., a feedstock, including a feedstock containing a fatty acid or alkane) under conditions whereby one or more target molecules is produced. In various embodiments of the methods provided herein, a target molecule, e.g., a fatty acid, including, for example, a dicarboxylic acid (e.g., adipic acid), and salts and/or esters thereof, is isolated or purified from the culture media or extracted from the engineered cells or organisms. Target molecule yield may be expressed as percent (%) theoretical yield, percent (%) maximum theoretical yield, units of target molecule produced per unit of feedstock added (e.g., grams of target molecule produced per gram of feedstock added), units of target molecule per volume of culture (e.g., grams of target molecule per liter of culture), units of target molecule per volume of cells (e.g., grams of target molecule per liter of cells), units of target molecule per weight of cells (e.g., grams of target molecule per dry cell weight (DCW) of cells), units of target molecule per volume of culture per unit of time (e.g., grams of target molecule per liter of culture per hour), and/or fold change (increase or decrease) when comparing target molecule production by a modified cell to production by an unmodified cell.

In some embodiments, fermentation of feedstocks by methods described herein can produce a target molecule product at a level of about 10% to about 100% of theoretical yield (e.g., about 15%, about 20%, about 25% or more of theoretical yield (e.g., 25% or more, 26% or more, 27% or more, 28% or more, 29% or more, 30% or more, 31% or more, 32% or more, 33% or more, 34% or more, 35% or more, 36% or more, 37% or more, 38% or more, 39% or more, 40% or more, 41% or more, 42% or more, 43% or more, 44% or more, 45% or more, 46% or more, 47% or more, 48% or more, 49% or more, 50% or more, 51% or more, 52% or more, 53% or more, 54% or more, 55% or more, 56% or more, 57% or more, 58% or more, 59% or more, 60% or more, 61% or more, 62% or more, 63% or more, 64% or more, 65% or more, 66% or more, 67% or more, 68% or more, 69% or more, 70% or more, 71% or more, 72% or more, 73% or more, 74% or more, 75% or more, 76% or more, 77% or more, 78% or more, 79% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more of theoretical yield). The term "theoretical yield" as used herein refers to the amount of product that could be made from a starting material if the reaction is 100% complete. Theoretical yield is based on the stoichiometry of a reaction and ideal conditions in which starting material is completely consumed, undesired side reactions do not occur, the reverse reaction does not occur, and there are no losses in the work-up procedure. Culture media may be tested for target product concentration and drawn off when the concentration reaches a predetermined level. Detection methods are known in the art, including but not limited to chromatographic methods (e.g., gas chromatography) or combined chromatographic/mass spectrometry (e.g., GC-MS) methods. Target product may be present at a range of levels as described herein.

A target product sometimes is retained within an engineered cell or organism after a culture process is completed, and in certain embodiments, the target product is secreted out of the cell or organism into the culture medium. For example, in some embodiments in which a target molecule is secreted, culture media may be drawn from the culture system and fresh medium may be supplemented, and/or target product may be extracted from the culture media during or after the culture process is completed. Engineered cells or organisms may be cultured on or in solid, semi-solid or liquid media. In some embodiments media is drained from cells adhering to a plate. In certain embodiments, a liquid-cell mixture is centrifuged at a speed sufficient to pellet the cells but not disrupt the cells and allow extraction of the media, as known in the art. The cells may then be resuspended in fresh media. Target product may be purified from culture media according to methods known in the art.

Provided herein are non-limiting examples of methods useful for recovering target product from fermentation broth and/or isolating/partially purifying a target product from non-target products when utilizing mixed chain length feedstocks. Recovery of a fatty dicarboxylic acid (e.g., adipic acid, sebacic acid, suberic acid, octanedioic acid, decanedioic acid, dodecanedioic acid, tetradecanedioic acid, hexadecanedioic acid, octadecanedioic acid, eicosanedioic acid) from fermentation broth can be accomplished using a variety of methods. Generally, for example, the cells are filtered away from the media, and the target molecule is extracted with a water-imiscible solvent appropriate for target chemical. Optionally, a centrifugation step can first be employed to separate cell mass and a fatty dicarboxylic acid from the aqueous phase.

A fatty dicarboxylic acid has limited solubility in water under fermentation conditions, and can have a density similar to that of water. In some embodiments, upon centrifugation, the majority of fatty dicarboxylic acid may be pulled away from the water stream, and be concentrated in the cell mass stream. The concentrated fatty dicarboxylic acid stream can then be further concentrated via filtration steps (e.g., solid dodecanedioic acid will be retained on a filter, allowing water to pass through, concentrating the product). Once the fatty dicarboxylic acid is concentrated to the desired level, the temperature can be increased to above its melting point of 130° C. After the fatty dicarboxylic acid is melted, the remaining impurities can be removed via filtration; the final product may be recovered by decreasing the temperature, allowing the fatty dicarboxylic acid to solidify, and collecting the solid product.

Alternatively, a fatty dicarboxylic acid can be recovered from fermentation broth by first extracting the broth with an organic solvent in which a fatty dicarboxylic acid is soluble. The organic solvent phase can then be filtered through various membranes to further purify the fatty dicarboxylic acid. Subsequent extractions with the same or a different organic solvent can then be performed and each round of extraction can be followed by membrane filtration to further concentrate the fatty dicarboxylic acid. The organic solvent can be evaporated, leaving the fatty dicarboxylic acid behind as a residue and the residue can be dried to provide the fatty dicarboxylic acid in solid form.

In certain embodiments, target product is extracted from the cultured engineered cells or organisms. The cells may be concentrated through centrifugation at a speed sufficient to shear the cell membranes. In some embodiments, the cells may be physically disrupted (e.g., shear force, sonication) or chemically disrupted (e.g., contacted with detergent or other lysing agent). The phases may be separated by centrifugation or other method known in the art and target product may be isolated according to known methods.

Commercial grade target product sometimes is provided in substantially pure form (e.g., 90% pure or greater, 95% pure or greater, 99% pure or greater or 99.5% pure or greater). In some embodiments, target product may be modified into any one of a number of downstream products. For example, a fatty dicarboxylic acid (e.g., octanedioic acid, decanedioic acid, dodecanedioic acid, tetradecanedioic acid, hexadecanedioic acid, octadecanedioic acid, eicosanedioic acid) may be polycondensed with hexamethylenediamine to produce nylon. Nylon may be further processed into fibers for applications in carpeting, automobile tire cord and clothing. A fatty dicarboxylic acid can also be used for manufacturing plasticizers, lubricant components and polyester polyols for polyurethane systems. Various esters of food grade fatty dicarboxylic acids can be used as components in fragrance manufacture, gelling aids, flavorings, acidulant, leavening and buffering agent. A fatty dicarboxylic acid has two carboxylic acid (—COOH) groups, which can yield two kinds of salts. Its derivatives, acyl halides, anhydrides, esters, amides and nitriles, are used in making a variety of downstream products through further reactions of substitution, catalytic reduction, metal hydride reduction, diborane reduction, keto formation with organometallic reagents, electrophile bonding at oxygen, and condensation.

Target product may be provided within cultured cells and organisms containing target product, and cultured cells may be supplied fresh or frozen in a liquid media or dried. Fresh or frozen cells or organisms may be contained in appropriate moisture-proof containers that may also be temperature controlled as necessary. Target product sometimes is provided in culture medium that is substantially cell-free. In some embodiments target product or modified target product purified from cells or organisms is provided, and target product sometimes is provided in substantially pure form. In certain embodiments crystallized or powdered target product is provided. For example, dodecanedioic acid (1,12 dodecanedioic acid; DDDA) is a white powder or crystal with a melting point of between 260° F. and 266° F. Sebacic acid (1,8 ocatanedicarboxylic acid) is also a white powder or crystal with a melting point of between 268° F. and 274° F. A crystallized or powdered fatty dicarboxylic acid may be transported in a variety of containers including one ton cartons, drums, 50 pound bags and the like.

In certain embodiments, a target product is produced with a yield of about 0.50 grams of target product per gram of feedstock or carbon source added, or greater; 0.51 grams of target product per gram of feedstock or carbon source added, or greater; 0.52 grams of target product per gram of feedstock or carbon source added, or greater; 0.53 grams of target product per gram of feedstock or carbon source added, or greater; 0.54 grams of target product per gram of feedstock or carbon source added, or greater; 0.55 grams of target product per gram of feedstock or carbon source added, or greater; 0.56 grams of target product per gram of feedstock or carbon source added, or greater; 0.57 grams of target product per gram of feedstock or carbon source added, or greater; 0.58 grams of target product per gram of feedstock or carbon source added, or greater; 0.59 grams of target product per gram of feedstock or carbon source added, or greater; 0.60 grams of target product per gram of feedstock or carbon source added, or greater; 0.61 grams of target product per gram of feedstock or carbon source added, or greater; 0.62 grams of target product per gram of feedstock or carbon source added, or greater; 0.63 grams of target product per gram of feedstock or carbon source added, or greater; 0.64 grams of target product per gram of feedstock or carbon source added, or greater; 0.65 grams of target product per gram of feedstock or carbon source added, or greater; 0.66 grams of target product per gram of feedstock or carbon source added, or greater; 0.67 grams of target product per gram of feedstock or carbon source added, or greater; 0.68 grams of target product per gram of feedstock or carbon source added, or greater; 0.69 grams of target product per gram of feedstock or carbon source added, or greater; 0.70 grams of target product per gram of feedstock or carbon source added or greater; 0.71 grams of target product per gram of feedstock or carbon source added, or greater; 0.72 grams of target product per gram of feedstock or carbon source added, or greater; 0.73 grams of target product per gram of feedstock or carbon source added, or greater; 0.74 grams of target product per gram of feedstock or carbon source added, or greater; 0.75 grams of target product per gram of feedstock or carbon source added, or greater; 0.76 grams of target product per gram of feedstock or carbon source added, or greater; 0.77 grams of target product per gram of feedstock or carbon source added, or greater; 0.78 grams of target product per gram of feedstock or carbon source added, or greater; 0.79 grams of target product per gram of feedstock or carbon source added, or greater; 0.80 grams of target product per gram of feedstock or carbon source added, or greater; 0.81 grams of target product per gram of feedstock or carbon source added, or greater; 0.82 grams of target product per gram of feedstock or carbon source added, or greater; 0.83 grams of target product per gram of feedstock or carbon source added, or greater; 0.84 grams of target product per gram of feedstock or carbon source added, or greater; 0.85 grams of target product per gram of feedstock or carbon source added, or greater; 0.86 grams of target product per gram of feedstock or carbon source added, or greater; 0.87 grams of target product per gram of feedstock or carbon source added, or greater; 0.88 grams of target product per gram of feedstock or carbon source added, or greater; 0.89 grams of target product per gram of feedstock or carbon source added, or greater; 0.90 grams of target product per gram of feedstock or carbon source added, or greater; 0.91 grams of target product per gram of feedstock or carbon source added, or greater; 0.92 grams of target product per gram of feedstock or carbon source added, or greater; 0.93 grams of target product per gram of feedstock or carbon source added, or greater; 0.94 grams of target product per gram of feedstock or carbon source added, or greater; 0.95 grams of target product per gram of feedstock or carbon source added, or greater; 0.96 grams of target product per gram of feedstock or carbon source added, or greater; 0.97 grams of target product per gram of feedstock or carbon source added, or greater; 0.98 grams of target product per gram of feedstock or carbon source added, or greater; 0.99 grams of target product per gram of feedstock or carbon source added, or greater; 1.0 grams of target product per gram of feedstock or carbon source added, or greater; 1.1 grams of target product per gram of feedstock or carbon source added, or greater; 1.2 grams of target product per gram of feedstock or carbon source added, or greater; 1.3 grams of target product per gram of feedstock or carbon source added, or greater; 1.4 grams of target product per gram of feedstock or carbon source added, or greater; 1.5 grams of target product per gram of feedstock or carbon source added, or greater; 1.6 grams of target product per gram of feedstock or carbon source added, or greater; 1.7 grams of target product per gram of feedstock or carbon source added, or greater; 1.8 grams of target product per gram of feedstock or carbon source added, or greater; 1.9 grams of target product per gram of feedstock or carbon source added, or greater; or about 2.0 grams of target product per gram of feedstock or carbon source added, or greater.

$Y_{max}$ is maximum theoretical yield. It is the amount of product that can be produced for a given biochemical pathway given a certain amount of consumed feedstock (e.g., grams adipic acid/grams oleic acid). Programs are available to calculate $Y_{max}$ values that can include algorithms used to calculate flux balance (see, e.g., COBRA; Becker et al. (2007) Nature Protocols 2:727-738). In some embodiments, the maximum theoretical yield ($Y_{max}$) of adipic acid in an engineered cell or organism is about 0.92 grams of adipic acid produced per gram of oleic acid added. In some embodiments, the maximum theoretical yield ($Y_{max}$) of suberic acid in an engineered cell or organism is about 0.96 grams of suberic acid produced per gram of oleic acid added. In some embodiments, the maximum theoretical yield ($Y_{max}$) of sebacic acid in an engineered cell or organism is about 0.99 grams of sebacic acid produced per gram of oleic acid added. In some embodiments, the maximum theoretical yield ($Y_{max}$) of docecanedioic acid in an engineered cell or organism is about 1.02 grams of dodecanedioic acid produced per gram of oleic acid added. In some embodiments, the maximum theoretical yield ($Y_{max}$) of 3-hydroxy-propionic acid in an engineered cell or organism is about 1.91 grams of 3-hydroxy-propionic acid produced per gram of oleic acid added. In some embodiments, the maximum theoretical yield ($Y_{max}$) of triacetic acid lactone in an engineered cell or organism is about 1.00 grams of triacetic acid lactone produced per gram of oleic acid added. In some embodiments, the maximum theoretical yield ($Y_{max}$) of lycopene in an engineered cell or organism is about 1.20 grams of lycopene produced per gram of oleic acid added. In some embodiments of the engineered cells and organisms and target production methods provided herein in which a carbon recycle loop is included in the engineered cell or organism, the $Y_{max}$ for production of a particular target molecule using a particular carbon source(s) is greater than it is for the same cell or organism that does not include an engineered carbon recycle loop. In some embodiments, for example, the $Y_{max}$ may be at least about 5% to about 100% greater for a modified cell or organism engineered to include a carbon recycle loop than for the same cell or organism that does not contain an engineered recycle loop. For example, in some embodiments, the $Y_{max}$ can be at least about 5%, 6%, 7%, 8%, 9%, 10%, 11%, 12%, 13%, 14%, 15%, 16%, 17%, 18%, 19%, 20%, 21%, 22%, 23%, 24%, 25%, 30%, 35%, 40%, 45%, 50%, 55%, 60%, 65%, 70%, 75%, 80%, 85%, 90%, 95% or 100% greater for a modified cell or organism engineered to include a carbon recycle loop than for the same cell or organism that does not contain an engineered recycle loop.

The percentage of $Y_{max}$ for the engineered cell or organism under conditions in which a target molecule is produced is calculated as (% $Y_{max}$)=$Y_{p/s}$Y/(% $Y_{max}$) $Y_{max}$*100, where ($Y_{p/s}$)=[target molecule (g/L)]*final volume of culture in flask (L)]/[feedstock added to flask (g)]. In some embodiments, the engineered cell or organism produces target molecule at about 10% to about 100% of maximum theoretical yield. In some embodiments, the engineered cell or organism produces target molecule at about 10% or greater of maximum theoretical yield, 15% or greater of maximum theoretical yield, 20% or greater of maximum theoretical yield, 25% or greater of maximum theoretical yield, 30% or greater of maximum theoretical yield, 35% or greater of maximum theoretical yield, 40% or greater of maximum theoretical yield, 45% or greater of maximum theoretical yield, 50% or greater of maximum theoretical yield, 55% or greater of maximum theoretical yield, 60% or greater of maximum theoretical yield, 65% or greater of maximum theoretical yield, 70% or greater of maximum theoretical yield, 75% or greater of maximum theoretical yield, 80% or greater of maximum theoretical yield, 85% or greater of maximum theoretical yield, 90% or greater of maximum theoretical yield, 95% or greater of maximum theoretical yield, or 100% of maximum theoretical yield.

In certain embodiments, a target molecule product (e.g., adipic acid, suberic acid, sebacic acid, dodecanedioic acid, 3-hydroxy-propionic acid, triacetic acid lactone, terpene) is produced with a yield of greater than about 0.15 grams per gram of the feedstock or carbon source (e.g., dodecane, mixed chain length alkanes, lauric acid, mixed chain length fatty acids, oil, the like or combinations of the foregoing). In some embodiments, a target molecule product is produced at between about 10% and about 100% of maximum theoretical yield of any introduced feedstock or carbon source ((e.g., about 15%, about 20%, about 25% or more of theoretical yield (e.g., 25% or more, 26% or more, 27% or more, 28% or more, 29% or more, 30% or more, 31% or more, 32% or more, 33% or more, 34% or more, 35% or more, 36% or more, 37% or more, 38% or more, 39% or more, 40% or more, 41% or more, 42% or more, 43% or more, 44% or more, 45% or more, 46% or more, 47% or more, 48% or more, 49% or more, 50% or more, 51% or more, 52% or more, 53% or more, 54% or more, 55% or more, 56% or more, 57% or more, 58% or more, 59% or more, 60% or more, 61% or more, 62% or more, 63% or more, 64% or more, 65% or more, 66% or more, 67% or more, 68% or more, 69% or more, 70% or more, 71% or more, 72% or more, 73% or more, 74% or more, 75% or more, 76% or more, 77% or more, 78% or more, 79% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more of theoretical maximum yield).

In certain embodiments, a target molecule product is produced in a concentration range of between about 50 g/L to about 1000 g/L of culture media (e.g., about 50 g/L, about 55 g/L, about 60 g/L, about 65 g/L, about 70 g/L, about 75 g/L, about 80 g/L, about 85 g/L, about 90 g/L, about 95 g/L, about 100 g/L, about 110 g/L, about 120 g/L, about 130 g/L, about 140 g/L, about 150 g/L, about 160 g/L, about 170 g/L, about 180 g/L, about 190 g/L, about 200 g/L, about 225 g/L, about 250 g/L, about 275 g/L, about 300 g/L, about 325 g/L, about 350 g/L, about 375 g/L, about 400 g/L, about 425 g/L, about 450 g/L, about 475 g/L, about 500 g/L, about 550 g/L, about 600 g/L, about 650 g/L, about 700 g/L, about 750 g/L, about 800 g/L, about 850 g/L, about 900 g/L, about 950 g/L, or about 1000 g/L).

In some embodiments, a target molecule product is produced at a rate of between about 0.5 g/L/hour to about 5 g/L/hour (e.g., about 0.5 g/L/hour, about 0.6 g/L/hour, about 0.7 g/L/hour, about 0.8 g/L/hour, about 0.9 g/L/hour, about 1.0 g/L/hour, about 1.1 g/L/hour, about 1.2 g/L/hour, about 1.3 g/L/hour, about 1.4 g/L/hour, about 1.5 g/L/hour, about 1.6 g/L/hour, about 1.7 g/L/hour, about 1.8 g/L/hour, about 1.9 g/L/hour, about 2.0 g/L/hour, about 2.25 g/L/hour, about 2.5 g/L/hour, about 2.75 g/L/hour, about 3.0 g/L/hour, about 3.25 g/L/hour, about 3.5 g/L/hour, about 3.75 g/L/hour, about 4.0 g/L/hour, about 4.25 g/L/hour, about 4.5 g/L/hour, about 4.75 g/L/hour, or about 5.0 g/L/hour.)

In certain embodiments, the engineered cell or organism produces between about 5-fold to about 500-fold more target molecule (a particular fatty acid, dicarboxylic acid, or other target molecule) compared to the amount produced by a wild-type or partially engineered cell or organism of the same strain, under identical fermentation conditions (e.g., about a 5-fold increase, about a 10-fold increase, about a 15-fold increase, about a 20-fold increase, about a 25-fold increase, about a 30-fold increase, about a 35-fold increase, about a 40-fold increase, about a 45-fold increase, about a 50-fold increase, about a 55-fold increase, about a 60-fold increase, about a 65-fold increase, about a 70-fold increase, about a 75-fold increase, about a 80-fold increase, about a 85-fold increase, about a 90-fold increase, about a 95-fold increase, about a 100-fold increase, about a 125-fold increase, about a 150-fold increase, about a 175-fold increase, about a 200-fold increase, about a 250-fold increase, about a 300-fold increase, about a 350-fold increase, about a 400-fold increase, about a 450-fold increase, or about a 500-fold increase).

In some embodiments, the engineered cell or organism produces a yield of target molecule (e.g., a particular fatty acid, dicarboxylic acid, or other target molecule), in terms of the percentage of the maximum theoretical yield ($Y_{max}$) that the yield is, that is greater than the yield (as a percentage of maximum theoretical yield) produced by a wild-type or partially engineered cell or organism of the same strain, under identical culture conditions. For example, the yield of a target molecule produced by an engineered or modified cell or organism provided herein can be a percent of maximum theoretical yield that is at least about 1 unit or more greater, 2 units or more greater, 3 units or more greater, 4 units or more greater, 5 units or more greater, 6 units or more greater, 7 units or more greater, 8 units or more greater, 9 units or more greater, 10 units or more greater, 11% units or more greater, 12 units or more greater, 13% units or more greater, 14 units or more greater, 15 units or more greater, 16 units or more greater, 17 units or more greater, 18 units or more greater, 19 units or more greater, 20 units or more greater, 21 units or more greater, 22 units or more greater, 23 units or more greater, 24 units or more greater, 25 units or more greater, 26 units or more greater, 27 units or more greater, 28 units or more greater, 29 units or more greater, 30 units or more greater, 31 units or more greater, 32 units or more greater, 33 units or more greater, 34 units or more greater, 35 units or more greater, 36 units or more greater, 37 units or more greater, 38 units or more greater, 39 units or more greater, 40 units or more greater, 41 units or more greater, 42 units or more greater, 43 units or more greater, 44 units or more greater, 45 units or more greater, 46 units or more greater, 47 units or more greater, 48 units or more greater, 49 units or more greater, 50 units or more greater, or more than 50 units greater than the yield (as a percentage of maximum theoretical yield) of the target molecule produced by a wild-type or partially engineered cell or organism of the same strain (i.e., a reference cell or organism) under the same culture conditions, wherein a unit is defined as 1% of the maximum theoretical yield. As an illustration, if the yield of a target molecule produced by an unmodified reference cell or organism is, for example, 80% of the maximum theoretical yield ($Y_{max}$), then a target molecule yield of an engineered cell or organism that is 1 unit greater would be 81% of the maximum theoretical yield, and a target molecule yield of an engineered cell or organism that is 5 units greater would be 85% of the maximum theoretical yield, and a target molecule yield of an engineered cell or organism that is 10 units greater would be 90% of the maximum theoretical yield, and so on.

EXAMPLES

The examples set forth below illustrate certain embodiments and do not limit the technology. Certain examples set forth below utilize standard recombinant DNA and other biotechnology protocols known in the art. Many such techniques are described in detail in Maniatis, T., E. F. Fritsch and J. Sambrook (1982) *Molecular Cloning: a Laboratory Manual*; Cold Spring Harbor Laboratory, Cold Spring Harbor, N.Y. DNA mutagenesis can be accomplished using the Stratagene (San Diego, CA) "QuickChange" kit according to the manufacturer's instructions.

Non-limiting examples of recombinant DNA techniques and genetic manipulation of microorganisms are described herein. In some embodiments, strains of engineered organisms described herein can be mated to combine genetic backgrounds to further enhance carbon flux management through native and/or engineered pathways described herein, for the production of a desired target product (e.g., sebacic or dodecanedioic acid).

Example 1: Construction of Shuttle Vectors and Template Expression Vectors

Nucleotide sequences of nucleic acids and amino acid sequences of polypeptides referred to in the Examples that follow are provided in Examples 24-27.

Construction of the Shuttle Vector pAA061

Vector pAA061 was constructed from a pUC19 backbone to harbor the selectable marker URA3 (e.g., nucleotide SEQ ID NO: 54 and amino acid SEQ ID NO: 1) from *Candida* strain ATCC 20336 as well as modifications to allow insertion of *Candida* strain ATCC 20336 promoters and terminators. A 1,507-bp DNA fragment containing the promoter (e.g., SEQ ID NO: 55), ORF (e.g., SEQ ID NO: 54), and terminator (e.g., SEQ ID NO: 56) of URA3 from *Candida* strain ATCC 20336 was amplified using primers oAA0124 and oAA0125. The URA3 PCR product was cut with NdeI/MluI and ligated into the 2,505-bp fragment of pUC19 cut with NdeI/BsmBI (an MluI compatible overhang was produced by BsmBI). In order to replace the lac promoter with a short 21-bp linker sequence, the resulting plasmid was opened with SphI/SapI and filled in with a linker produced by annealing oligos oAA0173 and oAA0174. The resulting plasmid was named pAA061 (FIG. 12).

Cloning of Promoter and Terminator Pairs into Vector pAA061

The multiple cloning site in pAA061 allows the insertion of promoter and terminator sequences from *Candida* strain ATCC 20336 that can subsequently be used to control the expression of an ORF (FIG. 12). The following example describes the insertion of two different promoter/terminator pairs into pAA061. This cloning method is general and can be applied to the insertion of other promoter and/or terminator sequences into pAA061.

Construction of Vector pAA105

Vector pAA105 was constructed from base vector pAA061 to include the phosphoglycerate kinase (PGK) promoter (e.g., SEQ ID NO: 114) and terminator (e.g., SEQ ID NO: 115) regions from *Candida* strain ATCC 20336 with an intervening multiple cloning site for insertion of ORFs. The PGK promoter region was amplified by PCR from genomic DNA using primers oAA0347 and oAA0348. The 1,029-bp DNA fragment containing the PGK promoter was then cut with restriction enzymes PstI/XbaI. The PGK terminator region was amplified by PCR from genomic DNA using primers oAA0351 and oAA0352. The 396-bp DNA fragment containing the PGK terminator was then cut with restriction enzymes XbaI/NdeI. The 3,522-bp PstI/NdeI DNA fragment from pAA061 was used in a three-piece ligation reaction with the PGK promoter and terminator regions to produce plasmid pAA105 (FIG. 12 and FIG. 13). The sequence between the PGK promoter and terminator contains restriction sites for incorporating ORFs to be controlled by the constitutive PGK promoter. One example, plasmid pAA219, was constructed for expression of cytochrome P450 reductase (CPRB). The CPRB gene (e.g., coding nucleotide SEQ ID NO: 90) was amplified by PCR from *Candida* strain ATCC 20336 genomic DNA with primers oAA0570 and oAA0571. The resulting 2,071-bp amplicon was cut with BspQI and ligated into BspQI-cut plasmid pAA105 resulting in the expression vector pAA219 (FIG. 14).

Construction of Vector pAA073

Vector pAA073 was constructed from base vector pAA061 to include the acyl-CoA oxidase (POX4) promoter (e.g., SEQ ID NO: 117) and terminator (e.g., SEQ ID NO 116) regions from *Candida* strain ATCC 20336 with an intervening multiple cloning site for insertion of ORFs (FIG. 15). The POX4 promoter region was amplified by PCR from genomic DNA using primers oAA0208 and oAA0209. The 568-bp DNA fragment containing the POX4 promoter was then cut with restriction enzymes PstI/XmaI. The POX4 terminator region was amplified by PCR from genomic DNA using primers oAA0216 and oAA0217. The 214-bp DNA fragment containing the POX4 terminator was then cut with restriction enzymes XmaI/NdeI. The 3,522-bp PstI/NdeI DNA fragment from pAA061 was used in a three-piece ligation reaction with the POX4 promoter and terminator regions to produce plasmid pAA073 (FIG. 16 and SEQ ID NO: 110). The sequence between the POX4 promoter and terminator contains restriction sites (including SapI and BspQI) for incorporating ORFs to be controlled by the fatty acid-inducible POX4 promoter. One example, plasmid pAA153, was constructed for expression of cytochrome P450 monooxygenase A14 (CYP52A14). The CYP52A14 gene (see, e.g., international patent application no. PCT/US2012/045615 published as WO2013/006730) was amplified by PCR from *Candida* strain ATCC 20336 genomic DNA with primers oAA0519 and oAA0520. The resulting 1,613-bp amplicon was cut with BspQI and ligated into BspQI-cut plasmid pAA073 resulting in the expression vector pAA153 (FIG. 17). In another example, plasmid pAA218, was constructed for expression of cytochrome P450 reductase (CPRB). The CPRB gene was amplified by PCR from *Candida* strain ATCC 20336 genomic DNA with primers oAA0572 and oAA0573. The resulting amplicon was cut with BspQI and ligated into BspQI-cut plasmid pAA073 resulting in the expression vector pAA218.

Table 3 lists the names of plasmids with promoter and terminator combinations that were cloned into the shuttle vector pAA061. All promoters and terminators listed were cloned from *Candida* strain ATCC 20336.

TABLE 3

*Candida* strain ATCC 20336 gene promoter/terminator combinations cloned into shuttle vector pAA061

| Plasmid | Promoter | Terminator |
| --- | --- | --- |
| pAA072 | FAO1 | FAO1 |
| pAA073 | POX4 | POX4 |
| pAA074 | POX5 | POX5 |
| pAA105 | PGK | PGK |
| pAA332 | TEF1 | TEF1 |
| pAA334 | GPD | GPD |
| pAA335 | PEX11 | PEX11 |
| pAA1617 | HDE | PEX11 |

Example 2: Genetic Engineering Methods

Genomic DNA Preparation

Genomic DNA from yeast strains such as *Candida* strain ATCC 20336 can be prepared as follows. About 1.5 ml of an overnight culture of cells is centrifuged and the pellet is resuspended in about 200 µl of a solution containing 2% Triton X-100, 1% SDS, 100 mM NaCl, 10 MM Tris pH 8.0, and 1 mM EDTA. About 200 µl of acid washed glass beads are added with about 200 µl of phenol:chloroform:isoamyl alcohol (25:24:1) at a pH of about 8.0. The sample is vortexed for about 2 minutes after which about 200 µl of water is added. The sample is then centrifuged at 13,000 rpm for about 10 minutes. The aqueous layer is transferred to a new microcentrifuge tube and an equal volume of chloroform:isoamyl alcohol (24:1) solution is added. This sample is vortexed for 10 seconds and then centrifuged at 13,000 rpm for about 2 minutes. The aqueous layer is transferred to a new microfuge tube and 1 ml of ethanol is added. The tube is then placed at −80° C. for about 15 minutes and then spun at 13,000 rpm for 15 minutes to pellet the DNA. The DNA is washed with 70% ethanol and air-dried. The DNA is then resuspended in about 500 µl of water.

To calculate gene copy number, a qPCR method can be used as described by Jin et al (*Appl. Environ. Microbiol.* January 2003 vol. 69, no. 1, 495-503). qPCR is performed according to the manufacturer's instructions using either the Brilliant III Ultra-Fast SYBR® Green QPCR Master Mix (Agilent Technologies, Englewood, CO USA) or the QuantiTect Multiplex PCR NoROX Kit (Qiagen). Genomic DNA from *Candida* strain ATCC 20336 or plasmid DNA containing the actin gene from ATCC 20336 and a gene of interest can be used as standards.

Primers and probes can be made via standard DNA synthesis techniques and be obtained, for example, from Integrated DNA Technologies (Coralville, IA, USA).

Amplification of Gene Copy Number by Single-Crossover Integration of Linearized Vectors Linear DNA transformed into yeast can be integrated into the genome by homologous recombination. The localization of genomic integration is determined by the homologous sequence at the ends of the transformed DNA. In the case of vectors without a yeast autonomous replication sequence (ARS), integration may occur by so-called single-crossover integration of multiple tandem arrays. For example, as shown in FIG. 1, a nucleic acid, or gene, of interest (GOI) can be added to a host cell genome by recombination between homologous sequences in the transforming linear DNA and the host genome (sequences of the host cell nonfunctional ura3 gene in the example shown in FIG. 1). A Ura⁻ auxotrophic mutant containing a non-functional gene for orotidine 5'-phosphate decarboxylase (ura3) may be "rescued" to the Ura phenotype by the genomic integration of a functional URA3 gene. A plasmid containing a nucleic acid of interest (GOI) to be added to the host genome can be linearized by cutting in the middle of a functional URA3 gene in the plasmid and may integrate into the genome in multiple tandem arrays to generate a functional URA3 gene. Integration of only one copy of such a plasmid by single-crossover integration may not always result in a functional URA3 gene (FIG. 1, part A), however integration of tandem arrays ensures that a functional URA3 gene is formed (FIG. 1, part B). Vector pAA153 linearized by cutting in the middle of the URA3 ORF with ClaI is an example of a single-crossover vector (FIG. 18).

Construction of Antibiotic-Free Single-Crossover Cassettes

When a vector is linearized for single-crossover integration, all elements of the vector are integrated into the genome of the transformed organism, including any genes for antibiotic resistance used for maintaining the plasmid in *E. coli*. To avoid the integration of genes encoding antibiotic resistance into yeast production strains, plasmids were designed to allow the PCR amplification of linear DNA cassettes for single-crossover integration that did not contain antibiotic resistance genes. One example of this is the rearrangement of plasmid pAA153 (FIG. 17) to produce the antibiotic-free cassette plasmid pAA367 (FIG. 19). Plasmid pAA153 was used as the template for PCR amplification with primer pairs oAA2206/oAA2207 and oAA2208/oAA2209 producing amplicons of 1,022 bp and 2,822 bp, respectively. The two amplicons contained overlapping sequence allowing overlap extension PCR with primer pairs oAA2206/oAA2209 producing a 3,804-bp amplicon that was cloned into pCR-BluntII-TOPO (Thermo Fisher Scientific) resulting in plasmid pAA367 (FIG. 19). An antibiotic-free linear DNA cassette was amplified by PCR using pAA367 as template with primer pair oAA2206/oAA2209 and gel purified before transformation to remove the plasmid template. The 3,804-bp antibiotic-free cassette (FIG. 20) contains all of the critical DNA elements of plasmid pAA153 without the antibiotic resistance gene. Other antibiotic-free single-crossover cassettes were generated using the same general method of splitting the URA3 selectable marker on either side of the desired promoter, gene of interest, and terminator sequences.

Generation of a Ura⁻ Mutant of *Candida* Strain ATCC 20962

*Candida* strain ATCC 20962 (pox5::ura3/pox5::ura3 pox4a::ura3/pox4b:: URA3 is a beta-oxidation blocked (pox4Δ, pox5Δ) and Ura derivative of *Candida* strain ATCC 20336. To reutilize the URA3 marker for subsequent engineering, a Ura⁻ derivative was generated and isolated via the following method. A single colony having the Ura phenotype was inoculated into 3 mL YPD media (10 g/L Bacto Yeast Extract, 20 g/L Bacto Peptone, and 20 g/L dextrose) and grown overnight at 30° C. with shaking. The overnight culture was then harvested by centrifugation and resuspended in 1 mL YNB+YE (6.7 g/L Yeast Nitrogen Broth, 3 g/L Yeast Extract). The resuspension was then serially diluted in YNB+YE and 100 uL aliquots plated on YPD plates (incubation overnight at 30° C.) to determine titer of the original suspension. Additionally, triplicate 100 uL aliquots of the undiluted suspension were plated on SC Dextrose (Bacto Agar 20 g/L, Uracil 0.3 g/L, Dextrose 20 g/L, Yeast Nitrogen Broth 6.7 g/L, Amino Acid Dropout Mix 2.14 g/L) and 5-FOA at 3 different concentrations (0.5, 0.75, and 1 mg/mL). Plates were incubated for at least 5 days at 30° C. Colonies arising on the SC Dextrose+5-FOA plates were picked into 50 uL sterile, distilled water and 5 uL struck out to YPD and SC-URA (SC Dextrose medium without Uracil). Colonies growing only on YPD and not on SC-URA plates were then inoculated into 3 mL YPD and grown overnight at 30° C. with shaking. The overnight culture was then harvested by centrifugation and resuspended in 1.5 mL YNB (6.7 g/L Yeast Nitrogen Broth). The resuspension was then serially diluted in YNB and 100 uL aliquots plated on YPD plates (incubation overnight at 30° C.) to determine initial titer. Also, for each undiluted suspension, 1 mL was plated on SC-URA and incubated for up to 7 days at 30° C. Colonies on the SC-URA plates were revertants, and the isolate with the lowest reversion frequency ($<10^{-7}$) was designated sAA103 (ura3/ura3 pox4:: ura3/pox4::ura3 pox5::ura3/pox5::ura3) and used for subsequent strain engineering.

Construction of Double-Crossover Gene Knock-Out Cassettes with Recyclable URA3 Marker Linear DNA transformed into yeast can also be integrated into the genome by double-crossover homologous recombination. Constructs for knocking out the function of a gene of interest (GOI) in *Candida* strain ATCC 20336 (or its descendants) were designed by placing a URA3 selectable marker between 5' and 3' homologous sequences for the GOI (FIG. 21A). The URA3 selectable marker was designed to have DNA sequence direct repeats at the beginning and at the end of the gene sequence that provide a mechanism for removing the URA3 selectable marker from the genome by a second crossover homologous recombination event after integration of the linear DNA while retaining some of the linear DNA sequence for disruption of the GOI. This enables the transformed cell to subsequently receive additional transforming DNA using URA3 as a selectable marker and is thus referred to as "recycling" of the URA3 marker. The direct repeat can be the URA3 promoter, the URA3 terminator, or any other DNA sequence. After transformation of a double-crossover gene knock-out cassette into an Ura⁻ mutant, the URA3 marker allows selection on SC-URA plates for colonies that have integrated the construct (FIG. 21B) disrupting the GOI and generating an Ura phenotype. The Ura transformant can be isolated and subsequently treated to remove the functional URA3 gene so that the URA3 marker can be reused for another round of gene knock-out. The Ura+transformant (FIG. 21B) plated on media containing 5-fluoroorotic acid (5-FOA) will only grow by rendering the URA3 gene non-functional since cells that have an intact URA3 gene convert, through a series of reactions, 5-FOA to fluorodeoxyuridylate, which is toxic to the cells. The DNA sequence direct repeats provide a convenient means for the cell to "loop out" the URA3 gene by homologous recombination (FIG. 21C), resulting in a Ura⁻ phenotype with the DNA sequence direct repeat as a "scar" left behind at the gene knock out site. The URA3 selection marker may now be used again for further genetic modifications such as deletion of the second allele of a GOI (FIG. 22).

Construction of Double-Crossover Gene Knock-in Cassettes with Recyclable URA3 Marker As described in the previous example, linear DNA cassettes may integrate into the yeast genome by double crossover homologous recombination. The DNA cassettes from the previous example can be modified to knock out a first gene of interest, GOI1, while simultaneously integrating, or knocking in, a second gene of interest, GOI2 (FIG. 3A). The GOI2 may be placed under the control of any promoter and terminator desired, except for the URA3 promoter and terminator. After transformation of a Ura⁻ mutant, GOI1 is knocked out while GOI2 is knocked in and the URA3 marker confers a Ura phenotype (FIG. 3B). The URA3 marker can be recycled as described previously by selection on media containing 5-FOA converting the phenotype back to Ura⁻ (FIG. 3C).

Example 3: Modification of Nucleic Acids Encoding Carnitine Acetyltransferase

In order to generate new cells and organisms with altered carbon flux for enhanced production of target molecules, nucleic acid constructs were developed to introduce desired genetic modifications into host cells. The following Examples describe the construction and use of exemplary nucleic acid constructs in making genetic modifications of cells and organisms. Carnitine O-acetyltransferase (e.g., EC 2.3.1.7), also referred to herein as carnitine acetyltransferase, is an enzyme that reversibly links acetyl units from acetyl-CoA to the carrier molecule carnitine. In some organisms, such as, for example, certain yeast species, the enzyme is dually targeted to mitochondria and peroxisomes by N-terminal and C-terminal targeting signals, respectively (see, e.g., Elgersma et al. (1995) EMBO J. 14: 3472-3479 and Kawachi et al. (1996) Eur. J. Biochem. 238: 845-852). An N-terminal sequence is referred to as the mitochondrial targeting signal (mts) and a C-terminal sequence is referred to as the peroxisomal targeting sequence (pts). Peroxisomal acetyl-CoA not destined for the glyoxylate cycle can be converted to acetyl-carnitine by carnitine O-acetyltransferase. Due to its smaller size compared to acetyl-CoA, acetyl-carnitine is able to diffuse through pores in the peroxisomal membrane, across the cytoplasm to mitochondria where it is converted back to acetyl-CoA by mitochondrial carnitine O-acetyltransferase (see, e.g., Strijbis et al. (2008) Eukaryotic Cell 7: 610-618 and Strijbis et al. (2010) J. Biol. Chem. 285: 24335-24346).

One method for increasing the amount of cytosolic acetyl-CoA in an organism is to modify the expression of carnitine O-acetyltransferase to provide increased carnitine O-acetyltransferase activity in the cytoplasm. In one embodiment, increased activity can be obtained by increasing the amount of carnitine O-acetyltransferase enzyme in the cytosol. For example, engineered carnitine O-acetyltransferase proteins lacking amino acid sequence targeting signals that direct the enzyme to one or more cellular locations (e.g., peroxisomes and mitochondria) other than the cytosol can be expressed in host cells thereby increasing the amount of carnitine O-acetyltransferase in the cytosol. Such engineered proteins will remain in the cytoplasm after being produced by the organism. A modified carnitine O-acetyltransferase protein (Cat2p$^{\Delta mts \Delta pts}$) lacking a mitochondrial targeting signal (mts) and a peroxisomal targeting signal (pts) converts acetyl-carnitine in transit from the peroxisome to the mitochondria into acetyl-CoA in the cytoplasm. Modified carnitine O-acetyltransferases can be produced upon expression of heterologous nucleic acids encoding the proteins that have been introduced into host cells.

Cloning of DNA Encoding Cat2p from Candida Strain ATCC 20336

DNA encoding carnitine O-acetyltransferase (Cat2p) from Candida strain ATCC 20336 was amplified by PCR from genomic DNA using primers oAA2586 and oAA2587. The PCR product containing the DNA encoding Cat2p was purified and ligated into pCR-BluntII-TOPO vector (Thermo Fisher Scientific), transformed into competent TOP10 E. coli cells (Thermo Fisher Scientific) and clones containing PCR inserts were sequenced to confirm the correct nucleic acid sequence. The resulting sequence-confirmed plasmid was named pAA426.

Construction of CAT2 Knock Out Cassettes

Two CAT2 knock-out cassettes were constructed for disruption of the two CAT2 gene alleles in Candida strain ATCC 20336 using homologous recombination methods known in the art and described herein. Each cassette contained a 5' CAT2 DNA fragment and a 3' CAT2 DNA fragment (referred to as gene homology fragments) to provide sequence used in a first single cross over homologous recombination event that results in the insertion of the entire cassette into an endogenous CAT2 gene. Each cassette also contained a URA3 selectable marker gene positioned between the homology regions in the cassette. The selectable marker included a direct repeat of sequence of the URA3 gene promoter at the 3' end of the gene that facilitates a second cross over homologous recombination event that results in excision of most of the URA3 selectable marker gene from the allele. However, a portion of the cassette remains in the CAT2 gene allele, which thereby disrupts and effectively knocks out the function of the endogenous gene. The cassettes differed in the size of the CAT2 gene homology regions and the orientation of the URA3 selectable marker between the homology regions. Each deletion cassette was generated by combining three DNA fragments: a 5' CAT2 DNA fragment (i.e., gene homology fragment), a 3' CAT2 DNA fragment (i.e., gene homology fragment) and a URA3 gene fragment originally cloned from *Candida* strain ATCC 20336 for use as a selectable marker. In constructing the first CAT2 deletion cassette, a CAT2 5' homology DNA fragment was generated by amplifying a 5' region of the CAT2 gene from plasmid pAA426 using primers oAA2372 and oAA2373. A CAT2 3' homology DNA fragment was generated by amplifying a 3' region of the CAT2 gene from plasmid pAA426 using primers oAA2376 and oAA2377. A URA3 selectable marker DNA fragment ($P_{URA3}URA3T_{URA3}P_{URA3}$; see, e.g., SEQ ID NO: 57) was amplified by PCR from plasmid pAA298 (FIG. 23) using primers oAA2374 and oAA2375. The three PCR products were purified and combined in the same reaction to generate the first full-length deletion cassette which was assembled by overlap extension PCR. The cassette was then ligated into pCR-BluntII-TOPO generating plasmid pAA1519 (FIG. 24). The linear CAT2 deletion cassette could then be amplified from plasmid pAA1519 with primers oAA2372 and oAA2377.

In constructing the second CAT2 deletion cassette, a CAT2 5' homology DNA fragment was generated by amplifying a 5' region of the CAT2 gene from plasmid pAA426 using primers oAA2372 and oAA3312. A CAT2 3' homology DNA fragment was generated by amplifying a 3' region of the CAT2 gene from plasmid pAA426 using primers oAA3315 and oAA2377. A URA3 selectable marker DNA fragment was amplified from plasmid pAA298 using primers oAA3313 and oAA3314. The three PCR products were purified, and combined in the same reaction to generate the second full-length deletion cassette which was assembled by overlap extension PCR. The cassette was then ligated into pCR-Blunt II-TOPO generating plasmid pAA1520. The linear CAT2 deletion cassette could then be amplified from plasmid pAA1520 (FIG. 24) with primers oAA2372/ oAA2377.

Generation of Nucleic Acid Constructs Encoding Modified Carnitine Acetyltransferase Proteins Engineered nucleic acids encoding carnitine O-acetyltransferase lacking targeting signals were generated as follows. A portion of the CAT2 gene from *Candida* strain ATCC 20336 was PCR amplified from pAA426 using primers oAA4719 and oAA4720, generating a DNA fragment (CAT2$^{\Delta mts}$; SEQ ID NO: 60) encoding a truncated protein lacking the 18 N-terminal amino acids normally present in the wild-type enzyme (Cat2p$^{\Delta mts}$; FIG. 25A and FIG. 25B and SEQ ID NO: 3). A plasmid backbone was then amplified from plasmid pAA1164 (FIG. 26; SEQ ID NO: 112) using primers oAA4722 and oAA4723. This DNA fragment contained all the elements of the pCR-BluntII-TOPO vector, a split URA3 selectable marker (i.e., a URA3 DNA fragment that has been cleaved to yield a 5' URA3 fragment and a 3' URA3 fragment (referred to as homology regions)) originally cloned from *Candida* strain ATCC 20336, and the HDE1 gene promoter (SEQ ID NO: 113) and POX4 gene terminator (SEQ ID NO: 116), both from *Candida* strain ATCC 20336. The nucleic acid products amplified from pAA426 and pAA1164 contained overlapping sequence at their termini allowing directional ligation of the products to generate plasmid pAA1610. Plasmid pAA1610 contains the nucleic acid encoding the modified Cat2p° mts protein under the control of the HDE1 gene promoter and POX4 gene terminator positioned between the two separate fragments of the URA3 gene marker.

The nucleic acid segment encoding the three C-terminal residues of the modified Cat2p° mts protein was deleted from the CAT2$^{\Delta mts}$ DNA fragment by site-directed mutagenesis in order to remove the peroxisomal targeting sequence from the encoded protein. Plasmid pAA1610 was used as template and PCR amplified using primers oAA5319 and oAA5320 containing the desired mutation eliminating the C-terminal-encoding nucleic acids. The amplification reaction was digested with DpnI to eliminate the template plasmid before transformation into *E. coli* DH5α cells. One sequence verified construct was saved and named plasmid pAA1667. Plasmid pAA1667 is identical to pAA1610, other than the removal of the codons for the last 3 amino acids (the peroxisomal targeting sequence) of the Cat2p$^{\Delta mts}$ enzyme, resulting in the formation of a construct containing a modified DNA encoding Cat2p$^{\Delta mts \Delta pts}$ (FIG. 25A and FIG. 25B; SEQ ID NO: 4). The modified nucleic acid encoding Cat2p$^{\Delta mts \Delta Pts}$ was referred to as CAT2$^{\Delta mts \Delta pts}$ (SEQ ID NO: 61).

In order to generate a DNA fragment encoding a modified carnitine O-acetyltransferase protein containing a mitochondrial targeting sequence but lacking the peroxisomal targeting sequence (Cat2p$^{\Delta pts}$), genomic DNA from strain ATCC 20336 was PCR amplified using primers oAA6472 and oAA6473 to generate DNA fragment CAT2$^{\Delta pts}$ (see, e.g., SEQ ID NO: 62), which is a truncated CAT2 DNA fragment missing codons for the peroxisomal targeting sequence (PTS). A plasmid backbone containing all the elements of the pCR-BluntII-TOPO vector, a split URA3 (*Candida* strain ATCC 20336) selectable marker, and the HDE1 gene promoter and POX4 gene terminator (both from *Candida* strain ATCC20336) was then amplified from plasmid pAA1164 (FIG. 26) using primers oAA6367 and oAA6368. The nucleic acid products amplified from the genomic DNA and pAA1164 contained overlapping sequence at their termini allowing directional ligation of the products to generate plasmid pAA1876. Plasmid pAA1876 contains the nucleic acid encoding the modified Cat2p$^{\Delta pts}$ is protein under the control of the HDE1 gene promoter and POX4 gene terminator positioned between the two separate fragments of the URA3 gene marker.

Cloning and Modification of DNA Encoding Yat1p from *Candida* Strain ATCC 20336

Another method of increasing the amount or concentration of cytosolic acetyl-CoA in an organism is to modify the expression of carnitine acetyltransferase in the organism such that there is decreased carnitine acetyltransferase activity in cellular organelles. For example, by decreasing the activity level of carnitine acetyltransferase in the mitochondria, there is a corresponding decrease in mitochondrial conversion of acetyl-carnitine to acetyl-CoA. This can introduce a bottleneck in acetyl-carnitine processing in the mitochondria which can have the effect of diverting acetyl-carnitine from entering the mitochondria from the cytoplasm. Methods of decreasing carnitine acetyltransferase activity in cellular compartments, such as the mitochondria, of a *Candida* yeast strain include replacing the wild-type promoter of an endogenous CAT2 gene in the yeast with a weaker heterologous promoter and/or replacing or modifying a gene encoding a wild-type carnitine acetyltransferase such that the encoded modified or substituted carnitine acetyltransferase protein has a reduced enzyme activity.

The YAT1 gene from *Candida* strain ATCC 20336 encodes a cytoplasmic-targeted enzyme with a reduced carnitine acetyltransferase activity relative to the activity of the enzyme encoded by the endogenous CAT2 gene. DNA encoding the YAT1p protein (SEQ ID NO: 6) was amplified from genomic DNA using primers oAA9946 and oAA9947 and the PCR product was purified and the sequence was verified. A plasmid backbone containing all the elements of the pCR-BluntII-TOPO vector, a split URA3 (from *Candida* strain ATCC 20336) selectable marker, and the HDE1 gene promoter and POX4 gene terminator (both from *Candida* strain ATCC20336) was then amplified from plasmid pAA1164 (FIG. 26) using primers oAA4722 and oAA4723. The nucleic acid products amplified from *Candida* strain ATCC 20336 genomic DNA and pAA1164 contained overlapping sequence at their termini allowing directional ligation of the products to generate plasmid pAA1817. Plasmid pAA1817 contains the nucleic acid (see, e.g., SEQ ID NO: 63) encoding the YAT1 protein under the control of the HDE1 gene promoter and POX4 gene terminator positioned between the two separate fragments of the URA3 gene marker.

The Yat1p enzyme with carnitine acetyl transferase activity is normally targeted to the cytoplasm in *Candida* strain ATCC 20336. Modification of Yat1p to target the enzyme to the mitochondrial compartment of a yeast cell involved the addition of amino acids at the N-terminus of the wild-type protein to act as a mitochondrial targeting signal (MTS). The DNA sequences encoding the MTS for three genes encoding mitochondrial-targeted enzymes in *Candida* strain ATCC 20336 were cloned separately and added to the 5' end of the YAT1 gene coding sequence providing DNA encoding the required N-terminal amino acids for a functional MTS. DNA encoding the predicted MTS from the Cox4p (SEQ ID NO: 7), Cit1p (SEQ ID NO: 8) and Cat2p (SEQ ID NO: 9) proteins was added to the 5' end of the coding sequence of the YAT1 gene such that the resulting encoded protein contained the heterologous MTS in place of the native Yat1p initiating methionine (FIG. 27). Plasmid pAA1817 containing the DNA encoding the YAT1 protein was PCR amplified with primers oAA6771 and oAA6669 to yield an amplification product of the entire plasmid backbone and YAT1 gene without the codon for the initiating methionine. The DNA sequences encoding the Cox4p MTS (SEQ ID NO: 64), Cit1p MTS (SEQ ID NO: 65) and Cat2p MTS (SEQ ID NO: 66) sequences were amplified from genomic DNA of *Candida* strain ATCC 20336 using primer pairs oAA6772/oAA6773, oAA6774/oAA6775, and oAA6776/oAA6777, respectively. The PCR products containing the modified YAT1p-encoding DNA with plasmid backbone, and the MTS-encoding sequences were designed with overlapping sequence at their termini allowing directional ligation, generating plasmids pAA1967 (containing YAT1$^{COX4mts}$; SEQ ID NO: 67), pAA1968 (containing YAT1$^{+CIT1mts}$; SEQ ID NO: 68) and pAA1969 (containing YAT1$^{+CAT2mts}$; SEQ ID NO: 69). The modified YAT1p+mts-encoding DNA of each of plasmids pAA1967, pAA1968 and pAA1969 is under the control of the HDE1 gene promoter and POX4 gene terminator positioned between the two separate fragments of the URA3 gene marker.

Example 4: Modification of Nucleic Acids Encoding Thioesterase Proteins

One approach to altering cellular carbon flux to recapture cytoplasmic acetyl-CoA that would have been lost to growth and energy generation processes and divert it to use in target molecule production is through an engineered acetyl group carbon recycle loop as described herein. In an exemplary recycle loop, acetyl moieties generated in the breakdown of fatty acids in peroxisomal β-oxidation are diverted from their usual mitochondrial destination and to cytosolic fatty acid synthesis to regenerate a fatty acid that can be subjected to another cycle of peroxisomal β-oxidation. The cytosolic fatty acid that is synthesized is in the form of an acyl-CoA that can be utilized in non-target molecule processes, such as lipid synthesis, by the cell. To divert the synthesized acyl-CoA away from such processes and toward ω- and β-oxidation, it can be converted to a free fatty acid through the action of a thioesterase (e.g., EC 3.1.2.20) enzyme which catalyzes the release of coenzyme A from long-chain acyl-CoA. In yeast, thioesterases (TES) are present in the peroxisomal compartment of the cells to ensure that free coenzyme A is available for β-oxidation. In one method of producing free fatty acids in the cytoplasm of yeast, a peroxisomal thioesterase with activity on long chain fatty acids is heterologously expressed in the cytoplasm. In one embodiment, this can be accomplished by modifying nucleic acids encoding a yeast thioesterase to delete the portion of the nucleic acid encoding the peroxisomal targeting signal at the C-terminus of the protein.

Cloning DNA Encoding Tesp Proteins from *Candida* Strain ATCC 20336

*Candida* strain ATCC 20336 contains eight genes encoding peroxisomal thioesterases. DNA encoding proteins encoded by each gene was amplified by PCR from genomic DNA using the primers indicated in Table 4. The PCR products were purified and cloned into pCR-BluntII-TOPO. Sequence confirmed plasmids were named as listed in Table 4.

TABLE 4

Primers and plasmids used in amplification cloning of DNA encoding *Candida thioesterase* proteins*

| Thioesterase | Primers | Plasmid |
| --- | --- | --- |
| TES1-1 (nucleotide SEQ ID NO: 78; amino acid SEQ ID NO: 22) | oAA3582 oAA3583 | pAA895 |
| TES2-1 (nucleotide SEQ ID NO: 79; amino acid SEQ ID NO: 23) | oAA3584 oAA3585 | pAA896 |
| TES2-2 (nucleotide SEQ ID NO: 80; amino acid SEQ ID NO: 24) | oAA3584 oAA3585 | pAA897 |
| TES3-1 (nucleotide SEQ ID NO: 81; amino acid SEQ ID NO: 25) | oAA3586 oAA3587 | pAA898 |
| TES4-1 (nucleotide SEQ ID NO: 82; amino acid SEQ ID NO: 26) | oAA3588 oAA3589 | pAA899 |
| TES5-1 (nucleotide SEQ ID NO: 83; amino acid SEQ ID NO: 27) | oAA3590 oAA3591 | pAA900 |
| TES6-1 (nucleotide SEQ ID NO: 84; amino acid SEQ ID NO: 28) | oAA3592 oAA3593 | pAA902 |
| TES7-1 (nucleotide SEQ ID NO: 85; amino acid SEQ ID NO: 29) | oAA3594 oAA3595 | pAA903 |
| TES7-2 (nucleotide SEQ ID NO: 86; amino acid SEQ ID NO: 30) | oAA3594 oAA3595 | pAA908 |
| TES8-1 (nucleotide SEQ ID NO: 87; amino acid SEQ ID NO: 31) | oAA3596 oAA3597 | pAA904 |

*the "-1" and "-2" designations for the *thioesterases* indicate which member of the sequence-confirmed allelic pair is contained in the plasmid Construction of a TES3$^{\Delta pts}$ Mutant A mutant of Tes3p lacking a peroxisomal targeting sequence was constructed to retarget the Tes3p enzyme to the cytoplasm. DNA encoding Tes3p lacking the C-terminal 3 residues (SEQ ID NO: 88) was amplified from plasmid pAA898 with primers oAA6449 and oAA6450. A plasmid backbone containing all the elements of the pCR-BluntII-TOPO vector, a split URA3 selectable marker, and the HD1E gene promoter and POX4 gene terminator was then amplified from plasmid pAA1164 (FIG. 26) using primers oAA6367 and oAA6368. The nucleic acid products amplified from plasmids pAA898 and pAA1164 contained overlapping sequence at their termini allowing directional ligation of the products to generate plasmid pAA1609. Plasmid pAA1609 contains a nucleic acid encoding the Tes3p$^{\Delta pts}$ protein (SEQ ID NO: 32) under the control of the HDE1 gene promoter and POX4 gene terminator situated between the two separate fragments of the URA3 gene marker.

Modified forms of the proteins encoded by the other TES genes lacking a peroxisomal targeting sequence can be constructed as described for the construction of the DNA encoding Tes3p$^{\Delta pts}$. First, DNA encoding thioesterases lacking the C-terminal 3 residues is PCR amplified from each of pAA895, pAA896, pAA897, pAA899, pAA900, pAA902, pAA908 and pAA904. Then, to obtain a plasmid backbone containing all the elements of the pCR-BluntII-TOPO vector, a split URA3 selectable marker, the HD1E gene promoter and the POX4 gene terminator, plasmid pAA1164 is amplified using primers oAA6367 and oAA6368. The final plasmid for each Tes protein-encoding DNA can then be obtained by ligating the amplicons with the backbone amplified plasmid pAA1164 through directional ligation.

Example 5: Modification of Nucleic Acids Encoding Acetyl-CoA Carboxylase Proteins Cytosolic acetyl-CoA can be converted to malonyl-CoA by the enzyme acetyl-CoA carboxylase (EC 6.4.1.2). This biochemical step represents a committed step in fatty acid biosynthesis and can be highly regulated. One approach to increasing fatty acid biosynthesis in an organism is to increase the acetyl-CoA carboxylase (ACC1p) activity in the cytosol. Generally, ACC1p is regulated by feedback inhibition of acyl-CoA and also by phosphorylation. Because the dephosphorylated state is the active state of the enzyme, one approach for increasing ACC1p activity is to reduce or eliminate phosphorylation of the protein. In one embodiment, the endogenous ACC1 coding sequence is modified to encode an enzyme in which the phosphorylatable serine residues have been substituted with alanine residues thereby relieving the regulation by phosphorylation and dephosphorylation.

Cloning DNA Encoding Acc1p from *Candida* Strain ATCC 20336

Primers oAA0784 and oAA0785 were used to amplify DNA encoding Acc1p from genomic DNA of *Candida* strain ATCC 20336, and the resulting 6869-bp amplicon was cloned into pCR-BluntII-TOPO. The sequence-verified plasmid was named pAA245 (FIG. 28). The DNA sequence cloned into plasmid pAA245 included the entire open reading frame of the ACC1 gene and the partial sequence for an intron at the 5' end of the ACC1 coding sequence.

Mutation of ACC1 to Replace Serine-Encoding with Alanine-Encoding Sequences

An ACC1 gene fragment and 5' partial intron (see, e.g., SEQ ID NO: 75) were restriction cloned from pAA245 by cutting with BspQI and ligated into BspQI-cut plasmid pAA105 (FIG. 13) to put the gene under the control of the PGK promoter and terminator (SEQ ID NOS: 114 and 115, respectively) from *Candida* strain ATCC 20336. The resulting sequence-confirmed plasmid was named pAA326 (FIG. 29). A truncated version of the ACC1 gene encoding R643 to the stop codon was generated by cutting pAA326 with SpeI/XbaI and was cloned into plasmid pAA061 (FIG. 12) cut with the same enzymes. The resulting plasmid was named pAA1634 (FIG. 30) and provided a smaller plasmid template for performing site-directed mutagenesis. Site-directed mutagenesis was performed on pAA1634 using the primers shown in Table 5 to introduce the mutations listed in the Table and resulting in plasmids pAA1647, pAA1648, pAA1649, pAA1650, and pAA1900.

In order to generate mutant ACC1 gene fragments containing the entire protein coding sequence of nucleic acids, PCR products containing the HDE1 promoter from *Candida* strain ATCC 20336 and the 5'-end 1,926 bp of the ACC1 gene encoding M1 to S642 were cloned into each of the plasmids containing a truncated mutant ACC1 fragment resulting in plasmids pAA1906-pAA1909, and pAA1915. Additionally, plasmid pAA1910 was generated in the same manner, although the ACC1 gene in that plasmid did not contain any mutations. The S652A mutation was introduced into all of plasmids pAA1906-pAA1910 and pAA1915 by site-directed mutagenesis with primers oAA6691 and oAA6692 generating plasmids pAA1957-pAA1962.

TABLE 5

Primers used in generating nucleic acid sequences encoding ACC1p mutant proteins and plasmids containing the nucleic acids

| Truncated Plasmid | Mutation(s) | Primers | Full-Length Plasmid | IGR5 Integration Plasmid |
| --- | --- | --- | --- | --- |
| pAA1634 | None | None | pAA1910 | pAA2249 |
| pAA1647 | S1138A | oAA5668 oAA5669 | pAA1906 | pAA2245 |
| pAA1648 | S1153A | oAA5670 oAA5671 | pAA1907 | pAA2246 |
| pAA1649 | S1158A | oAA5672 oAA5673 | pAA1908 | pAA2247 |
| pAA1650 | S1153A, S1158A | oAA5690 oAA5691 | pAA1909 | pAA2248 |
| pAA1900 | S1138A, S1153A, S1158A | oAA6145 oAA6146 | pAA1915 | pAA2250 |
|  | S652A, S1138A | oAA6691 oAA6692 | pAA1957 | pAA2251 |
|  | S652A, S1153A | oAA6691 oAA6692 | pAA1958 | pAA2252 |
|  | S652A, S1158A | oAA6691 oAA6692 | pAA1959 | pAA2253 |
|  | S652A, S1153A, S1158A | oAA6691 oAA6692 | pAA1960 | pAA2254 |
|  | S652A | oAA6691 oAA6692 | pAA1961 | pAA2255 |
|  | S652A, S1138A, S1153A, S1158A | oAA6691 oAA6692 | pAA1962 | pAA2256 |

Construction of Double Crossover Integration Cassettes for ACC1 Mutants

The ACC1 mutant genes under the control of the HDE1 promoter and PGK terminator ($P_{HDE}$-ACC1-$T_{PGK}$) were PCR amplified from plasmids pAA1906-pAA1909, pAA1915, and pAA1957-pAA1962, as well as the unmodified ACC1 gene from pAA1910, with primers oAA7257 and oAA7258. The PCR products were cut with SbfI/MluI and ligated into plasmid pAA2153 cut with the same restriction enzymes. Plasmid pAA2153 contains DNA encoding a URA3 selectable marker with a direct repeat of the URA3 terminator sequence ($T_{URA3}$) sequence, i.e., $T_{URA3}$-$P_{URA3}$-URA3-$T_{URA3}$ (see, e.g., SEQ ID NO: 58). The URA3 selectable marker in pAA2153 is placed between genomic DNA sequence elements from *Candida* strain ATCC 20336 which are named IGR5. The IGR5-5' (SEQ ID NO: 125; 446 bp) and IGR5-3' (SEQ ID NO: 126; 500 bp) homology regions target the integration of the intervening DNA into genomic DNA by homologous recombination. Plasmids constructed for the integration of ACC1 mutants at IGR5 were named pAA2245-pAA2256 (see, e.g., FIG. 31). Linear DNA used for transformation was generated by PCR with primers oAA7259 and oAA7260 using plasmids pAA2245-pAA2256 as template DNA.

Example 6: Modification of Nucleic Acids Encoding Acetyl-Carnitine Transporter Proteins Another approach to increasing the amount of cytosolic acetyl-CoA in an organism is to retain acetyl-carnitine within the cytoplasm that would otherwise be transported out of the cytoplasm and into organelles, such as the mitochondria. One method for increasing the amount of acetyl-carnitine within the cytoplasm is to reduce the transport of acetyl-carnitine into the mitochondria or other organelles. Mitochondria possess two membranes with the outer membrane generally allowing free diffusion of metabolites and the inner membrane controlling metabolite transport with multiple membrane transport proteins. One mitochondrial inner-membrane transport protein (Crc1p) may function as an acetyl-carnitine transporter providing for transport of acetyl-carnitine into the mitochondria (see, e.g., van Roermund et al. (1999) *EMBO J.* 18: 5843-5852 and Palmieri et al. (1999) *FEBS Lett.* 462: 472-476), Without being bound or limited by theory, reducing the amount of this acetyl-carnitine transporter in the mitochondrial membrane can create a bottleneck in the transport of acetyl-carnitine into the mitochondria resulting in accumulation of acetyl-carnitine in the cytoplasm. The cytoplasmic acetyl-carnitine can then be converted to acetyl-CoA by a cytoplasmic carnitine O-acetyltransferase (e.g., Cat2p$^{\Delta mts \Delta pts}$) as described herein. Reduction in the amount of Crc1p can be achieved, for example, by modifying the promoter controlling expression of DNA encoding Crc1p in a cell through introduction of heterologous nucleic acids encoding the protein into host cells that do not express a functional Crc1p transporter.

Cloning DNA Encoding Crc1p from *Candida* Strain ATCC 20336

The amount of CRC1p transporter expressed in the mitochondrial membrane in *Candida* host cells can be reduced by disrupting or deleting the endogenous CRC1 gene and replacing it with a heterologous transporter-encoding construct under the control of a promoter that is weaker than the native CRC1 promoter as described herein. DNA encoding a mitochondrial inner membrane acetyl-carnitine transport protein Crc1p (amino acid SEQ ID NO: 14; nucleotide SEQ ID NO: 71) was amplified from genomic DNA of *Candida* strain ATCC 20336 with primers oAA5511 and oAA5512. The amplified DNA was gel purified and cloned into the pCR-BluntII-TOPO vector. Plasmids isolated from transformants were sequenced and one sequence-verified plasmid was saved as plasmid pAA1564.

Construction of CRC1 Knock-Out Cassettes

CRC1 gene knock-out cassettes were constructed for use in generating host cells that could then be transformed with heterologous nucleic acids for modified expression of Crc1p. Two CRC1 knock-out cassettes were constructed for disruption of the two endogenous CRC1 gene alleles in *Candida* strain ATCC 20336 using homologous recombination methods known in the art and described herein. Each cassette contained a 5' CRC1 DNA fragment and a 3' CRC1 DNA fragment (referred to as gene homology fragments) to provide sequence used in a first crossover homologous recombination event that results in integration of the entire cassette into an endogenous CRC1 gene. Each cassette also contained a URA3 selectable marker gene positioned between the homology regions in the cassette. The selectable marker included a direct repeat of sequence of the URA3 gene promoter at the 3' end of the gene that facilitates a second cross over homologous recombination event that results in excision of most of the URA3 gene from the allele. However, a portion of the cassette remains in the CRC1 gene which thereby disrupts and effectively knocks out the function of the endogenous gene. The cassettes differed in the sizes of the CRC1 gene homology regions and the orientation of the URA3 selectable marker between the homology regions. Each deletion cassette was generated by combining three DNA fragments: a 5' CRC1 DNA fragment (i.e., gene homology fragment), a 3' CRC1 DNA fragment (i.e., gene homology fragment) and a URA3 selectable marker.

In constructing the first CRC1 deletion cassette, a CRC1 5' homology DNA fragment was generated by amplifying a 5' region of the CRC1 gene from plasmid pAA1564 using primers oAA5511 and oAA5553. A CRC1 3' homology DNA fragment was generated by amplifying a 3' region of the CRC1 gene from plasmid pAA1564 using primers oAA5512 and oAA5554. A URA3 selectable marker DNA fragment ($P_{URA3}$URA3$T_{URA3}P_{URA3}$) was amplified by PCR from plasmid pAA298 (FIG. 23) using primers oAA5555 and oAA5556. The three PCR products were purified and combined in the same reaction to generate the first full-length deletion cassette which was assembled by overlap extension PCR. The cassette was then ligated into pCR-BluntII-TOPO generating plasmid pAA1613 (FIG. 32). The linear CRC1 deletion cassette could then be amplified from plasmid pAA1613 with primers oAA5511 and oAA5512.

A second CRC1 deletion cassette was constructed by inserting the URA3 selectable marker ($P_{URA3}$URA3$T_{URA3}P_{URA3}$) at a different location and in the opposite orientation as was done for plasmid pAA1613. A first PCR product was generated using plasmid pAA1564 as template and primers oAA5698 and oAA5699. This product contained 5' CRC1 and 3' CRC1 DNA fragments and all the elements of the pCR-Blunt II-TOPO vector. A second PCR product containing a URA3 selectable marker ($P_{URA3}$URA3$T_{URA3}P_{URA3}$) was generated using plasmid pAA298 as template and primers oAA5700 and oAA5701. The two PCR products contained overlapping sequence at their termini allowing directional ligation, generating plasmid pAA1701 (FIG. 32). The linear CRC1 deletion cassette could then be amplified from plasmid pAA1701 with primers oAA5511 and oAA5512.

Construction of Modified CRC1 Genes with a Heterologous Promoter

The promoter for the glucose-6-phosphate isomerase gene (G6PI) from *Candida* strain ATCC 20336 drives low level expression of the G6PI gene. The G6PI promoter (SEQ ID NO: 118) was amplified from genomic DNA with primers oAA7409 and oAA7410. The 745-bp amplified DNA fragment was gel purified and cloned into the pCR-Blunt II-TOPO vector. Plasmids isolated from transformants were sequenced, and one sequence-verified plasmid was saved as plasmid pAA2218.

A DNA fragment containing the G6PI promoter, CRC1 coding region, and POX4 terminator ($P_{G6P1}$-CRC1-$T_{POX4}$) from *Candida* strain ATCC 20336 was constructed by overlap extension PCR. The G6PI promoter was amplified from plasmid pAA2218 with primers oAA7403 and oAA7404, the CRC1 gene was amplified from plasmid pAA1564 using primers oAA7381 and oAA7382, and the POX4 terminator was amplified from plasmid pAA073 using primers oAA7379 and oAA7380. The three amplicons were used in a subsequent overlap extension PCR reaction with primers oAA7379 and oAA7403 to build the desired DNA fragment, $P_{G6P1}$-CRC1-$T_{POX4}$. A plasmid backbone containing the IGR5 homology regions and URA3 selectable marker (with $T_{URA3}$ repeat) was amplified from plasmid pAA2247 (FIG. 31) using primers oAA7377 and oAA7378. The resulting 6,223-bp amplified plasmid backbone and the 1,816-bp DNA fragment $P_{G6R1}$-CRC1-$T_{POX4}$ encoded overlapping sequence allowing directional ligation, resulting in plasmid pAA2214 SEQ ID NO: 122)6. A linear double crossover DNA cassette for genomic integration could then be amplified from plasmid pAA2214 using primers oAA7259 and oAA7260 (FIG. 33).

A plasmid containing an antibiotic-free single-crossover cassette encoding the CRC1 gene driven by the low expression G6PI promoter was also constructed. A DNA fragment encoding the elements $P_{G6R1}$-CRC1 was amplified from plasmid pAA2214 using primers oAA7624 and oAA7625. A plasmid backbone encoding all of the elements of the pCR-BluntII-TOPO, a split URA3 marker, and POX4 terminator was then amplified using primers oAA7265 and oAA7512 from plasmid pAA1164 (FIG. 26; SEQ ID NO: 112). In certain instances, a plasmid backbone was amplified from plasmid pAA1116 (SEQ ID NO: 123). The two PCR products encoded overlapping sequence at their termini allowing directional ligation placing the CRC1 gene under the control of the G6PI promoter and POX4 terminator, generating plasmid pAA2311 (FIG. 34; SEQ ID NO: 124). A 3,307-bp antibiotic-free linear DNA cassette was amplified by PCR using pAA2311 as template with primer pair oAA2206/oAA2209 and gel purified before transformation to remove the plasmid template.

Example 7: Modification of Nucleic Acids Encoding Acetyl-CoA Hydrolase Proteins

Another approach to increasing the amount of cytosolic acetyl-CoA in an organism is to facilitate the generation and transport of acetate from acetyl-CoA-containing organelles, such as peroxisomes, into the cytoplasm. Acetyl-CoA produced via beta-oxidation in the peroxisome may be converted to acetate by the action of acetyl-CoA hydrolase (e.g. EC 3.1.2.1). This enzyme is typically not localized to the peroxisomal compartment. In order to introduce acetyl-CoA hydrolase into peroxisomes, a heterologous nucleic acid construct was developed in which the enzyme coding sequence was modified to include DNA encoding a peroxisomal targeting signal at the C-terminus of the hydrolase and exclude a mitochondrial targeting sequence at the N-terminus. The acetate produced freely diffuses out of the peroxisome into the cytoplasm where it can be converted back to acetyl-CoA by the enzyme acetyl-CoA synthetase. The expression of acetyl-CoA synthetase can also be amplified by increasing the genomic copy number and by promoter replacement. The acetyl-CoA generated from acetate in the cytosol is not able to enter the mitochondria, and thus is not subject to loss due to use in mitochondrial metabolic pathways such as the TCA cycle, unlike acetyl groups in acetyl-carnitine which can be taken up by mitochondria. To decrease peroxisomal generation of acetyl-carnitine, the carnitine acetyltransferase gene (e.g., CAT2 in *Candida*) can be disrupted in cells that have been modified to produce peroxisomal acetate using, for example, CAT2 knock-out cassettes as described herein. To provide mitochondria in such CAT2-disrupted cells with acetyl-CoA for use in cellular energy production for cell viability, the cell can be transformed with nucleic acid encoding a carnitine acetyltransferase (e.g., a reduced activity version of the enzyme) targeted to mitochondria (e.g., YAT1$^{+mts}$) to restore a minimum amount of acetyl-CoA generation in the mitochondria.

The enzyme encoded by the ACH1 gene has acetyl-CoA hydrolase activity and is targeted to the mitochondria in *Candida* strain ATCC 20336. DNA encoding Ach1p (amino acid SEQ ID NO: 15 and nucleotide SEQ ID NO: 72) was amplified from genomic DNA of *Candida* strain ATCC 20336 by PCR using primers oAA6369 and oAA6370. The primers were designed to amplify a portion of the ACH1 gene such that the amplification product, ACH1$^{\Delta mts+pts}$, (1) lacked nucleic acid sequence encoding the N-terminal 11 amino acids that form the mitochondrial targeting sequence, and (2) included a nucleic acid sequence encoding a peroxisomal targeting sequence (Gly-Arg-Arg-Ala-Lys-Leu) at the C-terminus. A plasmid backbone containing all the elements of the pCR-BluntII-TOPO vector, a 5' URA3 homology region and a 3' URA3 homology region selectable marker, and the HDE gene promoter and POX4 gene terminator was then amplified from plasmid pAA1164 (FIG. 26) using primers oAA6367 and oAA6368. The nucleic acid products amplified from *Candida* strain ATCC 20336 and pAA1164 contained overlapping sequence at their termini allowing directional ligation of the products to generate plasmid pAA1846. Plasmid pAA1846 contains the nucleic acid encoding the ACH1$^{\Delta mts+pts}$ protein (amino acid SEQ ID NO: 16 and nucleotide SEQ ID NO: 73) under the control of the HDE1 gene promoter and POX4 gene terminator situated between the two separate fragments of the URA3 gene marker.

Example 8: Modification of Nucleic Acids Encoding Acetyl-CoA Synthetase Proteins Another approach to increasing the amount of cytosolic acetyl-CoA in an organism is to increase the acetyl-CoA synthetase activity in the cytoplasm. Acetyl-CoA synthetase (e.g., EC 6.2.1.1; also referred to as acetate-CoA ligase) can catalyze the conversion of acetate to acetyl-CoA. Thus, for example, acetate that diffuses into the cytoplasm after being produced in the peroxisome by the action of heterologous peroxisomal acetyl-CoA hydrolase, as described herein, can be converted to acetyl-CoA by the enzyme acetyl-CoA synthetase. One method for increasing the acetyl-CoA synthetase activity in the cytoplasm is to increase the expression of acetyl-CoA synthetase by, for example, increasing the genomic copy number of acetyl-CoA synthetase-encoding DNA (e.g., ACS1 and ACS2 genes) and/or by replacing the endogenous ACS1 and/or ACS2 promoter(s) with a stronger, high-expression heterologous promoter (e.g., the fatty acid-inducible hydratase-dehydrogenase-epimerase (HDE) gene promoter from *Candida*).

Cloning DNA Encoding Acs1p from *Candida* Strain ATCC 20336

DNA encoding an acetyl-CoA synthetase (acetate-CoA ligase; Acs1p) from *Candida* strain ATCC 20336 was amplified from genomic DNA using primers oAA6371 and oAA6372. A plasmid backbone containing all the elements of the pCR-BluntII-TOPO vector, a 5' URA3 and a 3' URA3 homology region selectable marker, and the HDE gene promoter and POX4 gene terminator from *Candida* strain ATCC 20336 was then amplified from plasmid pAA1164 (FIG. 26) using primers oAA6367 and oAA6368. The nucleic acid products amplified from *Candida* strain ATCC 20336 and pAA1164 contained overlapping sequence at their termini allowing directional ligation of the products to generate plasmid pAA1847. Plasmid pAA1847 contains a nucleic acid encoding the ACS1 protein (amino acid SEQ ID NO: 20 and nucleotide SEQ ID NO: 76) under the control of the HDE1 gene promoter and POX4 gene terminator situated between the two separate fragments of the URA3 gene marker.

Cloning DNA Encoding Acs2p from *Candida* Strain ATCC 20336

DNA encoding an acetyl-CoA synthetase (acetate-CoA ligase; Acs2p) from *Candida* strain ATCC 20336 was amplified from genomic DNA using primers oAA6470 and oAA6471. A plasmid backbone containing all the elements of the pCR-BluntII-TOPO vector, a 5' URA3 and a 3' URA3 homology region selectable marker, and the HDE1 gene promoter and POX4 gene terminator from *Candida* strain ATCC20336 was then amplified from plasmid pAA1164 (FIG. 26) using primers oAA6367 and oAA6368. The nucleic acid products amplified from *Candida* strain ATCC 20336 and pAA1164 contained overlapping sequence at their termini allowing directional ligation of the products to generate plasmid pAA1875. Plasmid pAA1875 contains a nucleic acid encoding the ACS2 protein (amino acid SEQ ID NO: 21 and nucleotide SEQ ID NO: 77) under the control of the HDE1 gene promoter and POX4 gene terminator situated between the two separate fragments of the URA3 gene marker.

Example 9: Modification of Nucleic Acids Encoding ATP Citrate Lyase Proteins

Another approach to increasing cytosolic acetyl-CoA is to increase the activity of ATP citrate lyase (e.g., EC 2.3.3.8) in the cytoplasm of host cells. This enzyme can catalyze the conversion of citrate to acetyl-CoA and oxaloacetate. For example, in oleaginous yeast, ATP citrate lyase typically is a heterodimeric enzyme (Acl1p/Acl2p) that converts citric acid from the TCA cycle that overflows into the cytoplasm into acetyl-CoA and oxaloacetate at the expense of an ATP. The acetyl-CoA can then used for the production of fatty acids and eventually triacylglycerides as a carbon-storage mechanism. One method of increasing ATP citrate lyase activity in the cytosol of host cells is to increase the amount of the enzyme in the cytosol. This can be accomplished in a number of ways. For example, heterologous DNA encoding Acl1p and Acl2p can be introduced into host cells and/or the regulation of expression of Acl1p and Acl2p in a cell can be modified.

Construction of Synthetic Nucleic Acids Encoding ATP Citrate Lyase Subunits

The amino acid sequences from NCBI accession numbers CAG80394 and XP_503231 for Acl1p (SEQ ID NO: 42) and Acl2p (SEQ ID NO: 43), respectively, from *Yarrowia lipolytica* CLIB122 were used to design DNA sequences (SEQ ID NOS: 96 and 97) encoding each enzyme subunit that were codon optimized for expression in *Candida* strain ATCC 20336. DNA fragments 500 bp in length with 50 bp overlaps (synthetic Gene blocks from Integrated DNA Technologies) were amplified in a PCR reaction without primers: 95° C. for 3 minutes for 1 cycle, 95° C. for 30 seconds, 60° C. for 30 seconds, 72° C. for 30 seconds for a total of 15 cycles, and final extension at 72° C. for 2 minutes. 5 µL of the PCR product was used as template for TouchDown PCR reaction (see, for example, Don et al. (1991) *Nucleic Acids Res.* 19:4008) including the primers: 95° C. for 3 minutes for 1 cycle, 95° C. for 30 seconds, 68° C. for 30 seconds, decreasing by 0.4° C. per cycle, 72° C. for 30 seconds for a total of 30 cycles, and final extension at 72° C. for 2 minutes. The primers used, oAA3051 and oAA3052 for ACL1 and oAA3053 and oAA3052 for ACL2, incorporated BspQI restriction sites outside of the coding sequence. The PCR products were purified and cloned into pCR-BluntII-TOPO. Sequence-confirmed plasmids were named pAA709 (ACL1) and pAA710 (ACL2).

Construction of Expression Cassettes for Synthetic ACL-Encoding Nucleic Acids

Synthetic DNA expression constructs encoding Acl1p and Acl2p were generated using different promoter and terminator elements contained in pAA073 (FIG. 16) and pAA1617. Plasmid pAA073 contains the POX4 promoter and terminator from *Candida* strain ATCC 20336. Plasmid pAA1617 was constructed from pAA061 (FIG. 12) as described herein, in the same manner that pAA073 was constructed from pAA061 except that it contains the HDE1 promoter and PEX11 terminator from *Candida* strain ATCC 20336 in place of the POX4 promoter and terminator as shown for pAA073.

Plasmids pAA709 and pAA710 were cut with BspQI and the DNA fragments containing coding sequences were purified and cloned into BspQI-cut plasmid pAA073, placing the genes under the control of the POX4 promoter and terminator. Sequence-confirmed plasmids were named pAA731 (ACL1) and pAA732 (ACL2). Similarly, the genes were PCR amplified with primers oAA6658 and oAA6659 for ACL1 and oAA6660 and oAA6661 for ACL2, cut with BspQI and cloned into BspQI-cut plasmid pAA1617 placing them under the control of the HDE1 promoter and PEX11 terminator. Sequence-confirmed plasmids were named pAA1980 (ACL1) and pAA1981 (ACL2).

Example 10: Modification of Nucleic Acids Encoding Acyl-CoA Synthetase and Cytochrome P450 Reductase Proteins Acyl-CoA synthetases (e.g., EC 6.2.1.3) are enzymes that can catalyze the activation of free fatty acids in the cytoplasm into CoA esters (fatty acyl-CoA) which can be involved in several metabolic pathways. When free fatty acids are activated and then used in other cellular processes, they generally are not available for the fatty acid and acetyl-CoA generation that can occur through β-oxidation in peroxisomes. Therefore, because acyl-CoA synthetases can reduce the amount of free fatty acids in the cytoplasm of an organism, such as a yeast, one approach to enhancing fatty acid and acetyl-CoA generation in an organism involves reduction or elimination of the activity of acyl-CoA synthetase activity in the cytoplasm. When acyl-CoA synthetase activity is decreased or eliminated, free fatty acids that accumulate in the cytoplasm can then enter the ω- and β-oxidation pathways.

A cytochrome P450 reductase (e.g., EC 1.6.2.4) is an enzyme that can catalyze the reduction of the heme thiolate moiety of cytochrome P450 by transferring an electron to the cytochrome P450. This activity recycles cytochrome P450 and makes it available for further use in catalyzing reactions that occur in ω-oxidation of fatty acids. This, in turn, can provide dicarboxylic acids that are able to undergo β-oxidation in peroxisomes which can result in generation of shorter-chain dicarboxylic acids and acetyl-CoA. Another approach to enhancing dicarboxylic acid and acetyl-CoA production is to increase the activity of cytochrome P450 reductase in an organism. This can be accomplished in a number of ways aimed at increasing the amount of cytochrome P450 reductase protein in the cells. For example, a method for simultaneously decreasing or eliminating acyl-CoA synthetase activity and increasing cytochrome P450 reductase activity in an organism is to disrupt a gene encoding an acyl-CoA synthetase and replace it with nucleic acid encoding a cytochrome P450 reductase.

Cloning Nucleic Acid Encoding the FAA1p from ATCC 20336

The *Candida* strain ATCC 20336 FAA1 and CPRB genes encode an acyl-CoA synthetase (amino acid SEQ ID NO: 35 and nucleotide SEQ ID NO: 91) and cytochrome P450 reductase (amino acid SEQ ID NO: 34 and nucleotide SEQ ID NO: 90), respectively. A double-crossover knock-in cassette was constructed for use in disrupting a *Candida* host strain FAA1 gene by integrating into the host genome at the FAA1 locus a DNA encoding a CPRB protein under the control of the *Candida* strain ATCC 20336 POX4 promoter and terminator. A DNA fragment encoding the Faa1p acyl-CoA synthetase was amplified from genomic DNA of *Candida* strain ATCC 20336 using primers oAA951 and oAA952. The PCR product was gel purified and ligated into pCR-Blunt II-TOPO (Thermo Fisher Scientific), transformed into competent TOP10 *E. coli* cells (Thermo Fisher Scientific) and clones containing PCR inserts were sequenced to confirm the DNA sequence. One such plasmid was designated pAA275.

Construction of a Cassette for Disruption of FAA1 with DNA Encoding CPRBp

A DNA fragment from a 5' region of the FAA1 gene was amplified from plasmid pAA275 using primers oAA3557 and oAA3558, and a DNA fragment from a 3' region of the FAA1 gene was amplified from plasmid pAA275 using primers oAA3563 and oAA3564. The URA3 selectable marker ($P_{URA3}URA3T_{URA3}P_{URA3}$) was amplified from plasmid pAA298 (FIG. 23; SEQ ID NO: 111) using primers oAA3559 and oAA3560. A DNA fragment containing an ORF of a *Candida* strain ATCC 20336 CPRB gene surrounded by the POX4 promoter and terminator was amplified from plasmid pAA218 using primers oAA3561 and oAA3562. The two PCR products from amplification of pAA275, and the PCR products from amplification of pAA298 and pAA218 were purified, assembled by overlap extension PCR with primers oAA3557 and oAA3564 and ligated into pCR-BluntII-TOPO generating plasmid pAA879 (FIG. 35). The linear FAA1 deletion cassette could then be amplified from plasmid pAA879 with primers oAA3557 and oAA3564.

Example 11: Modification of Nucleic Acids Encoding Cytochrome P450 Monooxygenase Proteins A cytochrome P450 enzyme (e.g., monooxygenase activity, EC 1.14.14.1) often catalyzes the insertion of one atom of oxygen bound to the heme group in cytochrome P450 into an organic substrate (RH) while the other oxygen atom is reduced to water. This activity can occur in the initial step in the ω-oxidation pathway in which a fatty acid can be converted to a corresponding fatty alcohol. Dicarboxylic acids that are ultimately produced after completion of all steps in the ω-oxidation pathway generally are able to undergo β-oxidation in peroxisomes which results in generation of shorter-chain dicarboxylic acids and acetyl-CoA. Another approach to enhancing dicarboxylic acid and acetyl-CoA production is to increase the activity of cytochrome P450 monooxygenase in a cell. One method for increasing the cytochrome P450 monooxygenase activity in a cell is to increase the expression of cytochrome P450 monooxygenase by, for example, increasing the genomic copy number of cytochrome P450 monooxygenase-encoding DNA (e.g., CYP52A17 gene) and/or by replacing an endogenous cytochrome P450 monooygenase promoter with a stronger, high-expression heterologous promoter (e.g., the fatty acid-inducible hydratase-dehydrogenase-epimerase (HDE) gene promoter from *Candida*).

DNA encoding cytochrome P450 monooxygenase A17 (CYP52A17; amino acid SEQ ID NO: 45 and nucleotide SEQ ID NO: 99) from *Candida* strain ATCC 20336 was amplified from genomic DNA using primers oAA5770 and oAA5771. A plasmid backbone containing all the elements of the pCR-BluntII-TOPO vector, a split URA3 marker and the HDE gene promoter and POX4 gene terminator was amplified from plasmid pAA1164 (FIG. 26) using primers oAA5768 and oAA5769. The nucleic acid products amplified from *Candida* strain ATCC 20336 and pAA1164 contained overlapping sequence at their termini allowing directional ligation of the products to generate plasmid pAA1712. Plasmid pAA1712 contains nucleic acid encoding the CYP52A17 protein under the control of the HDE1 gene promoter and POX4 gene terminator situated between the two separate fragments of the URA3 selectable marker.

Example 12: Modification of Nucleic Acids Encoding Acyl-CoA Oxidase and Peroxisomal Biogenesis Proteins Acyl-CoA oxidases can be involved in the β-oxidation pathway that occurs in the peroxisomes of many cells and organisms in which long-chain acyl-CoA molecules can be broken down into acetyl-CoA molecules and shorter chain acyl-CoA molecules. The β-oxidation pathway generally includes four main reaction steps resulting in an acyl-CoA that is shortened by two carbon atoms which are released as acetyl-CoA. The shortened acyl-CoA molecule can re-enter the pathway after each cycle and be subjected to another removal of two carbons from the acyl carbon chain. As such, each cycle of the β-oxidation pathway generates a shorter-chain fatty acid and acetyl-CoA, and is a major source of acetyl-CoA in cells. There are multiple acyl-CoA oxidases expressed in yeast and other cells and organisms. These acyl-CoA oxidases can have differing substrate specificities. For example, the peroxisomal acyl-CoA oxidases encoded by the POX4 and POX5 genes of *Candida* strain ATCC 20336 exhibit differing activities. The Pox4p enzyme has broad chain length fatty acid specificity whereas the Pox5p enzyme is not very active on fatty acids with short chain lengths. The Pox5p enzyme displays optimal activity on fatty acid substrates of 12 to 18 carbons and a decreased activity on substrates below C10 with a low activity on C6 and C8 substrates.

The catabolism of fatty acids through β-oxidation can be manipulated to serve, in effect, as a process for the production of shorter-chain fatty acids from long-chain acyl-CoA molecules. This can be accomplished by modifying enzymatic activities of the β-oxidation pathway to reduce or eliminate activities that break down fatty acids once they reach a certain short-chain length. For example, one approach to targeting production of short chain dicarboxylic acids (e.g., adipic acid) through the β-oxidation pathway is to delete or disrupt the POX4 gene in a cell or organism, such as a yeast, e.g., *Candida*. Elimination or reduction of Pox4p acyl-CoA oxidase activity prevents breakdown of long-chain dicarboxylic acids to dicarboxylic acid products with fewer than eight carbon atoms (i.e., chain length shorter than C8) by peroxisomal β-oxidation. One method of disrupting the POX4 gene and simultaneously introducing a desired nucleic acid for enhancing generation of shorter-chain dicarboxylic acids and acetyl-CoA through modification of β-oxidation is to replace the POX4 gene with nucleic acid encoding a peroxisomal membrane protein that promotes peroxisome biogenesis, such as the protein encoded by a yeast PEX11 (peroxisomal biogenesis factor 11) gene from *Candida* strain ATCC 20336.

Cloning DNA Encoding Pex11p from *Candida* Strain ATCC 20336

DNA encoding a Pex11p (amino acid SEQ ID NO: 33 and nucleotide SEQ ID NO: 89) from *Candida* strain ATCC 20336 was PCR amplified from genomic DNA using primers oAA2127 and oAA2128. The PCR product was purified, cut with BspQI, and ligated into BspQI-cut plasmid pAA073 to operably position the PEX11 gene fragment under the control of the POX4 promoter and terminator. The resulting sequence-confirmed plasmid was named pAA336.

Construction of a Cassette for Disruption of POX4 by Insertion of Nucleic Acid Encoding Pex11p A double-crossover knock-in cassette was constructed to integrate into a host cell genome at the POX4 locus, DNA encoding *Candida* strain ATCC 20336 Pex11p under the control of the POX4 promoter and terminator. A DNA fragment containing a 5' homology region of the *Candida* strain ATCC 20336 POX4 gene and a *Candida* strain ATCC 20336 URA3 gene selectable marker ($P_{URA3}URA3T_{URA3}P_{URA3}$) was amplified by PCR from plasmid pAA208 (FIG. 36; SEQ ID NO: 127) with primers oAA3156 and oAA3354. A DNA fragment containing a 3' homology region of the *Candida* strain ATCC 20336 POX4 gene was amplified by PCR from plasmid pAA208 with primers oAA3159 and oAA3356. A DNA fragment containing the coding sequence of the PEX11 gene under the control of the POX4 promoter and terminator was amplified by PCR from plasmid pAA336 with primers oAA3157 and oAA3158. All three DNA fragments were assembled by overlap PCR and primers oAA3355 and oAA3357. The 5,190-bp PCR product was then cloned into pCR-BluntII-TOPO and the resulting plasmid was named plasmid pAA850 (FIG. 37).

Modification of DNA Encoding Pox5p

In a cell, such as a *Candida* yeast cell, in which Pox5p is the primary or only functional acyl-CoA oxidase, long chain fatty acyl-CoA or diacyl-CoA substrates can be shortened to about 8 carbons and do not typically enter another cycle of β-oxidation for further shortening of the carbon chain length. The shorter substrates (e.g., a C8 fatty dicarboxylic acid) are not typically recognized as a substrate by Pox5p. In such cells, shorter chain fatty-acyl-CoA molecules are then acted on by peroxisomal thioesterases resulting in removal of Co-A, and the released fatty dicarboxylic acid (e.g., an α,ω-dicarboxylic acid) product is secreted from the cell. In this instance, the acyl-CoA oxidase chain-length substrate specificity effectively controls the chain length of the fatty acid, e.g., a diacid, being produced.

Protein engineering of Pox5p was performed to identify mutants correlated with increased adipic acid production in yeast cells expressing the modified Pox5p enzymes during the fermentation process. A structural model of a Pox5p was created using SWISS-MODEL to identify amino acid positions to mutate. The SWISS-MODEL system has been described, for example, by Arnold et al. ((2006) *Bioinformatics* 22: 195-201), Guex et al. ((2009) *Electrophoresis* 30 Supplement 1: S162-S173) and Kiefer et al. ((2009) *Nucleic Acids Res.* 37 (Database issue): D387-D392). The crystal structure of rat peroxisomal acyl-CoA oxidase II (PDB ID: 11S2, chain A) (see, for example, Nakajima et al. (2002) *J. Biochem.* 131: 376-374) was used as the template to model Pox5p. The resulting structural model was analyzed using the HotSpot Wizard 1.7 program (Worldwide web Uniform Resource Locator (URL) loschmidt.chemi.muni.cz/hotspot-wizard/index.jsp) to determine amino acids to target for mutagenesis. HotSpot Wizard is a tool for identifying sites for engineering of substrate specificity and/or activity of enzymes using a combination of structural, functional and sequence analysis and has been described by Pavelka et al. ((2009) *Nucleic Acids Res.* 37 (Web Server issue): W376-W383). HotSpot Wizard identified several amino acid positions, or "hotspots," of Pox5p to mutate, with each position given a score from 1 (cold) to 9 (hot) (FIG. 38). The residues identified as hotspots (a score of 6 to 9) are generally found in the portions of the protein that form the walls of the catalytic site pocket and tunnels for entry or exit of the substrate. Part of the HotSpot Wizard analysis is the identification of homologs by a BLAST search (see, e.g., Johnson et al. (2008) *Nucleic Acids Res.* 36 (Web Server issue): W5-W9) and their alignment using MUSCLE as described, for example, by Edgar ((2004) *BMC Bioinformatics* 5: 113 and *Nucleic Acids Res.* 32: 1792-1797). The multiple sequence alignment revealed the variety of amino acids found at each position and their relative frequency amongst all the sequences. In the structural model of Pox5p, positions 98 and 429 are located near the back of the catalytic site pocket and are near the catalytic glutamate at position 436. These residues were identified as hotspots and were selected for substitution. Amino acid residue 98, phenylalanine, was identified as a hotspot (with a score of 9) and the residue most frequently found at this position amongst other homologs is glycine. In Pox5p of *Candida* ATCC 20336, the residue at position 98 is phenylalanine. Therefore, the phenylalanine codon at position 98 was changed to a glycine codon in one modified Pox5p-encoding DNA construct that was generated. The most common residue at amino acid position 429 (with a score of 6) in the analyzed homologs was a tryptophan, which is also the amino acid residue at position 429 in Pox5p of *Candida* ATCC 20336. Therefore, the tryptophan codon at position 429 was changed to the second most common residue, phenylalanine, in another modified Pox5p-encoding DNA construct that was generated. The HotSpot scores for residues 98 and 429 and the amino acids found at that position in the multiple sequence alignment are shown in Table 6.

TABLE 6

HotSpot Scores and comparison of amino acids at residues 98 and 429 in *Candida* Pox5p

| Amino Acid Position | HotSpot Score | Amino Acid in Pox5p of *Candida* ATCC 20336 | Residues at the Position from the Alignment |
|---|---|---|---|
| 98 | 9 | Phenylalanine | 12xG, 8xF, 5xA, 4xY, 3xP, 3xS, 3xW, 2xD, 2xQ, 2xR, 1xE, 1xH, 1xL, 1xN, 1Xv |
| 429 | 6 | Tryptophan | 23xW, 7xF, 7xY, 4xA, 4xV, 1xC, 1xI, 1xL, 1xN, 1xQ |

Site-Directed Mutagenesis of POX5

The POX5 mutants F98G and W429F were constructed by overlap extension PCR of the template pAA166 containing DNA encoding a wild-type Pox5p. To construct pAA166, oligonucleotides oAA540 and oAA541 were used to amplify DNA encoding Pox5p (amino acid SEQ ID NO: 36 and nucleotide SEQ ID NO: 92) from genomic DNA of Candida strain ATCC 20336. The resulting PCR fragment was digested with the restriction enzyme BspQI and ligated into BspQI-cut pAA073. The resulting plasmid pAA166 contained DNA encoding Pox5p positioned between the POX4 promoter and terminator from Candida strain ATCC 20336 and also contained a Candida strain ATCC 20336 URA3 gene selectable marker. The nucleic acids encoding POX5 mutants F98G and W429F were constructed by overlap extension PCR (FIG. 39) of pAA166 using the primers shown in the table shown in FIG. 39 as follows: PCR #1, using oligos A and B, and PCR #2, using oligos C and D were used to amplify the POX5 coding sequence. Oligos B and C contain the desired point mutation(s). The resulting PCR fragments from PCR #1 and #2 were then used as template and primer for each other to form the full-length coding sequence of the POX5 mutant in an overlap extension PCR. The resulting overlap extension PCR products were cloned into plasmid pAA073 via the BspQI restriction sites encoded by oligos A and D. The sequence-confirmed plasmids containing the Pox5p(F98G) (amino acid SEQ ID NO: 37) and Pox5p(W429F) (amino acid SEQ ID NO: 38) mutants were named pAA1055 and pAA1129, respectively. Each plasmid contained DNA encoding a Pox5p mutant (F98G or W429F) positioned between the POX4 promoter and terminator from Candida strain ATCC 20336 and also contained a Candida strain ATCC 20336 URA3 gene selectable marker. Plasmid pAA1164 (FIG. 26), containing DNA encoding a Pox5p mutant (F98G) positioned between, and operably linked to, the HDE1 promoter and POX4 terminator from Candida strain ATCC 20336 and also containing a Candida strain ATCC 20336 URA3 gene selectable marker, was also generated for expression of Pox5p(F98G).

Example 13: Modification of Nucleic Acids Encoding Peroxisomal Transport Proteins Another approach to enhancing the production of fatty acids, such as dicarboxylic acids, and increasing the amount of cytosolic acetyl-CoA is to reduce or eliminate the transport of fatty acyl-CoA from the cytoplasm of cells directly to peroxisomes. For example, fatty acyl-CoA generated in the cytoplasm can move into peroxisomes by ATP-binding cassette transporters responsible for transporting long-chain fatty acyl-CoA from the cytoplasm across the peroxisomal membrane and into the peroxisomal matrix. Exemplary peroxisomal transport proteins are encoded by yeast PXA1 and PXA2 (peroxisomal ATP-binding cassette transporter complex) genes. One method of reducing or eliminating the transport of fatty acyl-CoA from the cytoplasm into the peroxisome is to decrease the activity of Pxa1p and Pxa2p transport proteins. This can be accomplished, for example, through deletion or disruption of the PXA1 and/or PXA2 genes in an organism. By blocking import of activated acyl-CoA into the peroxisome in, for example, Candida host cells, the fatty acyl-CoA generated in the cytosol can be converted to free fatty acid available to undergo ω-oxidation to generate additional dicarboxylic acids for entry into the peroxisome and generation of shorter-chain fatty adds and acetyl-CoA through peroxisomal β-oxidation.

Cloning DNA Encoding Pxa1p from Candida Strain ATCC 20336

DNA encoding a Pxa1p (amino acid SEQ ID NO: 40 and nucleotide SEQ ID NO: 94) from Candida strain ATCC 20336 was PCR amplified from genomic DNA using primers oAA2125 and oAA2126. The PCR product, containing DNA encoding a Pxa1p, was purified and cloned into pCR-BluntII-TOPO vector. The resulting sequence-confirmed plasmid was named pAA353.

Construction of PXA1 Deletion Cassettes

Two PXA1 deletion cassettes for use in disrupting host cell PXA1 genes were constructed that differed in the size of the PXA1 homology sequences contained in the cassettes and the orientation of the URA3 selectable marker DNA positioned between the homology sequences. A first deletion cassette was constructed by amplifying 5' and 3' DNA fragments of PXA1 from plasmid pAA353 using primers oAA2679 and oAA2680 for amplifying a 5' DNA fragment and oAA2683 and oAA2684 for amplifying a 3' DNA fragment. A URA3 selectable marker ($P_{URA3}URA3T_{URA3}P_{URA3}$) was amplified from plasmid pAA298 using primers oAA2681 and oAA2682. The three PCR products were purified, assembled by overlap extension PCR and ligated into pCR-BluntII-TOPO generating plasmid pAA1117 (FIG. 40). A linear PXA1 deletion cassette could then be amplified from plasmid pAA1117 with primers oAA2679 and oAA2684.

A second deletion cassette was constructed by amplifying 5' and 3' DNA fragments of PXA1 from plasmid pAA353 using primers oAA2914 and oAA2915 for amplifying a 5' DNA fragment and oAA2918 and oAA2919 for amplifying a 3' DNA fragment. A URA3 selectable marker was amplified from plasmid pAA298 using primers oAA2916 and oAA2917. The three PCR products were purified, assembled by overlap extension PCR and ligated into pCR-BluntII-TOPO generating plasmid pAA1155 (FIG. 40). A linear PXA1 deletion cassette could then be amplified from plasmid pAA1155 with primers oAA2914 and oAA2919.

Cloning DNA Encoding Pxa2p from Candida Strain ATCC 20336

DNA encoding Pxa2p (amino acid SEQ ID NO: 41 and nucleotide SEQ ID NO: 95) from Candida strain ATCC 20336 was PCR amplified from genomic DNA using primers oAA2159 and oAA2162. The PCR product containing DNA encoding Pxa2p was purified and cloned into pCR-BluntII-TOPO vector. The resulting sequence-confirmed plasmid was named pAA354.

PXA2 deletion cassettes for use in disrupting host PXA2 genes can be constructed as described for the construction of PXA1 genes.

Example 14: Generation of Host Strains for Use in Development of Genetically Modified Organisms In some embodiments of exemplary methods for the development of genetically modified cells and organisms, host strains for transformation can carry beneficial mutations and/or amplifications. Examples include auxotrophic mutations (e.g., ura3) that facilitate selection of transformants, and mutations and/or amplifications yielding host cell alterations that serve to work in conjunction with subsequent engineered genetic modifications to enhance generation of cytosolic acetyl-CoA and/or production of fatty acids in the transformants. Alterations in an acyl-CoA oxidase (Pox4p, Pox5p), acyl-CoA synthetase (Faa1p, Fat1p), peroxisomal biogenesis factor 11 (Pex11p) and/or cytochrome P450 reductase (CPRBp) are non-limiting examples of host cell mutations and/or amplifications that can augment the subsequent genetic modifications introduced in the development of organisms for enhanced generation of cytosolic acetyl-CoA and/or production of fatty acids.

For example, in some embodiments, the activity of β- and/or ω-oxidation enzymes in host cells was amplified by placing the genes encoding them under the control of strong and/or inducible promoters and integrating them in additional copies in the genome. To allow the recycling of the URA3 selectable marker for additional genetic modification, some of these amplified genes were integrated by double-crossover integration at genetic loci providing a simultaneous deletion of an unwanted enzyme activity. For example, in some host cells, the PEX11 gene was integrated under the control of the POX4 promoter at the POX4 locus. This simultaneously provided the deletion of an unwanted activity (Pox4p, acyl-CoA oxidase with undesired substrate specificity) and amplification of a desired activity (Pex11p, peroxisome biogenesis factor). Examples of some possible host strains for use in developing genetically modified cells and organisms for enhanced production of cytosolic acetyl-CoA and/or production of fatty acids are described herein. FIG. 41 provides a flow diagram showing the parent-child relationship for some of the exemplary engineered yeast strains.

Cell Transformation Methods

Development of genetically modified cells and organisms can involve introduction of heterologous nucleic acids into cells using cell transformation methods described herein and/or known in the art. For example, generally, for the transformation of Candida yeast cells, 5 mL YPD start cultures are inoculated with a single colony of Candida cells and incubated overnight at 30° C., with shaking at about 200 rpm. The following day, fresh 25 mL YPD cultures, containing 0.05% Antifoam B, are inoculated to an initial $OD_{600\,nm}$ of 0.4 and the culture incubated at 30° C., with shaking at about 200 rpm until an $OD_{600\,nm}$ of 1.0-2.0 is reached. Cells are pelleted by centrifugation at 1,000×g, 4° C. for 10 minutes. Cells are washed by resuspending in 10 mL sterile water, pelleted, resuspended in 1 mL sterile water and transferred to a 1.5 mL microcentrifuge tube. The cells are then washed in 1 mL sterile TE/LiOAC solution, pH 7.5, pelleted, resuspended in 0.25 mL TE/LiOAC solution and incubated with shaking at 30° C. for 30 minutes.

The cell solution is divided into 50 μL aliquots in 1.5 mL tubes to which is added 5-8 μg of linearized transforming DNA and 5 μL of carrier DNA (boiled and cooled salmon sperm DNA, 10 mg/mL). Sterile PEG solution (300 μL of 40% PEG 3500, 1× TE, 1× LiOAC) is added, mixed thoroughly and incubated at 30° C. for 60 minutes with gentle mixing every 15 minutes. DMSO (40 μL) is added, mixed thoroughly and the cell solution is incubated at 42° C. for 15 minutes. Cells are then pelleted by centrifugation at 1,000×g 30 seconds, resuspended in 500 μL of YPD media and incubated at 30° C. with shaking at about 200 rpm for 2 hours. Cells are then pelleted by centrifugation and resuspended in 1 mL 1× TE, cells are pelleted again, resuspended in 0.2 mL 1× TE and plated on selective media. Plates are incubated at 30° C. for growth of transformants. Transformation methods using standard electroporation techniques are also described in U.S. Pat. Nos. 5,648,247 and 5,204,252.

Strain sAA886 (ura3/ura3 pox4a::ura3/pox4b::ura3 faa1::$P_{URA3}$/faa1::$P_{URA3}$ fat1-Δ1::$P_{URA3}$/fat1-Δ2::$P_{URA3}$)

Table 7 summarizes the genotypes and steps in the construction of Candida strain sAA886. Functional POX5 alleles were restored in Candida strain ATCC 20962 (also referred to as sAA003; ura3/ura3 pox4a::ura3/pox4b::URA3/pox5::ura3/pox5::ura3; see U.S. Pat. No. 5,254,466) by transformation of sAA003 with POX5 linear DNA to replace the URA3-disrupted loci with a functional allele. The POX5 DNA was obtained from pAA049 which was constructed by amplifying the entire sequence of NCBI accession number M12161 for the YSAPOX5 locus from genomic DNA prepared from Candida strain ATCC 20336 using primers oAA0179 and oAA0182. The 2,624-bp PCR product was cloned into the vector, pCR-BluntII-TOPO, sequenced and designated pAA049. A 2,624-bp DNA fragment containing the POX5 ORF as well as 456 bp upstream and 179 bp downstream of the ORF was amplified by PCR of plasmid pAA049 using primers oAA0179 and oAA0182. The purified PCR product was used to transform competent sAA003 cells which were plated on YNB agar plates supplemented with dodecane vapor as the carbon source (e.g., by placing a filter paper soaked with dodecane in the lid of an inverted petri dish) and incubated at 30° C. for 4-5 days. Colonies growing on dodecane as the sole carbon source were restreaked onto YPD-agar and incubated at 30° C. Single colonies were grown in YPD cultures and used for the preparation of genomic DNA. PCR analysis of the genomic DNA prepared from the transformants was performed with oligos oAA0179 and oAA0182. A ura3-disrupted POX5 would produce a PCR product of 4,784 bp while a functional POX5 would produce a PCR product of 2,624 bp. In a resulting strain, sAA235 (see also U.S. Pat. No. 8,343,752), a PCR product 2,624 bp was amplified indicating that both POX5 alleles had been functionally restored.

TABLE 7

Yeast strain genotypes and steps in constructing sAA886 and sAA2428

| Strain | Genotype | Construction |
| --- | --- | --- |
| sAA003 | ura3/ura3 pox4a::ura3/pox4b::URA3 pox5::ura3/pox5::ura3 | ATCC 20962 |
| sAA235 | ura3/ura3 pox4a::ura3/pox4b::URA3 POX5/POX5 | Transformation of sAA003 with PCR product using pAA049 as template and growth on YNB-dodecane |
| sAA329 | ura3/ura3 pox4a::ura3/pox4b::ura3 POX5/POX5 | Growth of sAA235 on 5-FOA |
| sAA722 | ura3/ura3 pox4a::ura3/pox4b::ura3 POX5/POX5 faa1::URA3/FAA1 | Transformation of sAA239 with BamHI/XhoI fragment of pAA276 |
| sAA741 | ura3/ura3 pox4a::ura3/pox4b::ura3 POX5/POX5 faa1::$P_{URA3}$/FAA1 | Growth of sAA722 on 5-FOA |
| sAA776 | ura3/ura3 pox4a::ura3/pox4b::ura3 POX5/POX5 faa1::$P_{URA3}$/faa1::URA3 | Transformation of sAA741 with BamHI/XhoI fragment of pAA282 |
| sAA779 | ura3/ura3 pox4a::ura3/pox4b::ura3 POX5/POX5 faa1::$P_{URA3}$/faa1::$P_{URA3}$ | Growth of sAA776 on 5-FOA |

TABLE 7-continued

Yeast strain genotypes and steps in constructing sAA886 and sAA2428

| Strain | Genotype | Construction |
|---|---|---|
| sAA865 | ura3/ura3 pox4a::ura3/pox4b::ura3 POX5/POX5 faa1::$P_{URA3}$/faa1::$P_{URA3}$ fat1-Δ1::URA3/FAT1 | Transformation of sAA779 with deletion cassette generated by OE-PCR |
| sAA869 | ura3/ura3 pox4a::ura3/pox4b::ura3 POX5/POX5 faa1::$P_{URA3}$/faa1::$P_{URA3}$ fat1-Δ1::$P_{URA3}$/FAT1 | Growth of sAA865 on 5-FOA |
| sAA875 | ura3/ura3 pox4a::ura3/pox4b::ura3 POX5/POX5 faa1::$P_{URA3}$/faa1::$P_{URA3}$ fat1-Δ1::$P_{URA3}$/fat1-Δ2::URA3 | Transformation of sAA869 with deletion cassette generated by OE-PCR |
| sAA886 | ura3/ura3 pox4a::ura3/pox4b::ura3 POX5/POX5 faa1::$P_{URA3}$/faa1::$P_{URA3}$ fat1-Δ1::$P_{URA3}$/fat1-Δ2::$P_{URA3}$ | Growth of sAA875 on 5-FOA |
| sAA2291 | ura3/ura3 pox4a::ura3/pox4b::ura3 pox5::URA3/POX5 faa1::$P_{URA3}$/faa1::$P_{URA3}$ fat1-Δ1::$P_{URA3}$/fat1-Δ2::$P_{URA3}$ | Transformation of sAA886 with a PacI-digested fragment of pAA918 (SEQ ID NO: 128) |
| sAA2310 | ura3/ura3 pox4a::ura3/pox4b::ura3 pox5Δ::$T_{URA3}$/POX5 faa1::$P_{URA3}$/faa1::$P_{URA3}$ fat1-Δ1::$P_{URA3}$/fat1-Δ2::$P_{URA3}$ | Growth of sAA2291 on 5-FOA |
| sAA2399 | ura3/ura3 pox4a::ura3/pox4b::ura3 pox5Δ::$T_{URA3}$/pox5::URA3 faa1::$P_{URA3}$/faa1::$P_{URA3}$ fat1-Δ1::$P_{URA3}$/fat1-Δ2::$P_{URA3}$ | Transformation of sAA2310 with a PacI-digested fragment of pAA918 |
| sAA2428 | ura3/ura3 pox4a::ura3/pox4b::ura3 pox5Δ::$T_{URA3}$/pox5Δ::$T_{URA3}$ faa1::$P_{URA3}$/faa1::$P_{URA3}$ fat1-Δ1::$P_{URA3}$/fat1-Δ2::$P_{URA3}$ | Growth of sAA2399 on 5-FOA |

In order to delete the FAA1 genes in the POX5-restored strain, sAA329 (generated by growing sAA235 on 5-FOA and selecting for Ura⁻ cells) was transformed with a fragment of pAA276 (FIG. 42) containing DNA from an FAA1 gene. FAA1 DNA was PCR amplified from *Candida* ATCC 20336 genomic DNA using primers oAA951 and oAA952. The PCR product was gel purified and ligated into pCR-BluntII-TOPO, transformed into competent TOP10 *E. coli* cells and clones containing PCR inserts were sequenced to confirm the DNA sequence. One such plasmid was designated pAA275. Plasmid pAA280 was digested with BamHI to release a 2.0 kb $P_{URA3}$URA3$T_{URA3}P_{URA3}$ cassette. Plasmid pAA275 was digested with Bg/II and gel purified. The DNA cassette and the Bg/II fragment of pAA275 were ligated together to generate plasmids pAA276 and pAA282. Plasmids pAA276 and pAA282 have the $P_{URA3}$URA3$T_{URA3}P_{URA3}$ cassette inserted between the 5' (N-terminal-encoding) and 3' (C-terminal-encoding) fragments of the FAA1 gene in opposite orientations.

Plasmid pAA276 was digested with BamHI/XhoI and column purified. Strain sAA329 (ura3/ura3 pox4a::ura3/pox4b::ura3 POX5/POX5) was transformed with the linearized DNA and plated on SCD-URA plate. Several colonies were checked for FAA1 disruption. One such strain was designated sAA722. Strain sAA722 was grown in YPD media overnight and plated on 5-FOA plate. Colonies that grew in the presence of 5-FOA were PCR screened for the looping out of the URA3 gene leaving behind only the URA3 promoter ($P_{URA3}$) in the FAA1 site. Out of 30 colonies analyzed, only one strain showed the correct genetic modification. The strain was designated sAA741. Plasmid pAA282 was digested with BamHI/XhoI and column purified. Strain sAA741 was transformed with the linearized DNA and plated on SCD-ura plate. Several colonies were checked for double FAA1 knockout by insertional inactivation. One such strain was designated sAA776. Strain sAA776 was grown in YPD media overnight and plated on 5-FOA plate. Colonies that grew in the presence of 5-FOA were PCR screened for the looping out of the URA3 gene leaving behind only the URA3 promoter ($P_{URA3}$) in both FAA1 gene alleles. One such strain was named sAA779.

Deletion of each FAT1 allele was achieved by transforming sAA779 cells with linear DNA cassettes constructed by overlap extension PCR (OE-PCR). The deletion cassette for the first FAT1 allele in sAA779 was created from three DNA fragments: one containing FAT1 5' DNA, one containing FAT1 3' DNA and one containing URA3 marker DNA. The first two DNA fragments containing the FAT1 DNA were obtained from DNA encoding Fat1p. The full-length coding sequence of the FAT1 gene was amplified from *Candida* strain ATCC 20336 genomic DNA using primers oAA1023 and oAA1024. The 2,086-bp PCR product was gel purified and ligated into pCR-Blunt II-TOPO, transformed into competent TOP10 *E. coli* cells and clones containing PCR inserts were sequenced to confirm correct DNA sequence. One such plasmid was named pAA296.

The first DNA fragment (FAT1 5' homology) was amplified from plasmid pAA296 using primers oAA2055 and oAA2056. The second DNA fragment (FAT1 3' homology) was amplified from plasmid pAA296 using primers oAA2069 and oAA2060. The third DNA fragment ($P_{URA3}$URA3$T_{URA3}P_{URA3}$) was amplified from plasmid pAA298 using primers oAA2057 and oAA2068. A map of plasmid pAA298 is set forth in FIG. 23. All three DNA fragments were combined in the same reaction to generate the full-length deletion cassette by overlap extension PCR using primers oAA2055 and oAA2060. Strain sAA779 was transformed with the full-length deletion cassette and plated on SCD-URA plate. Several colonies were screened by PCR for integration of the deletion cassette at the first FAT1 allele. One such strain was named sAA865. Strain sAA865 was grown in YPD media overnight and plated on 5-FOA plate. Colonies that grew in the presence of 5-FOA were PCR screened for the looping out of the URA3 gene leaving behind only the URA3 promoter ($P_{URA3}$) in the first FAT1 allele. One such strain was named sAA869. The deletion of the second FAT1 allele in sAA869 was performed by transformation with a deletion cassette created by overlap extension PCR. The deletion cassette for the second FAT1 allele was constructed from three DNA fragments. The first DNA fragment (FAT1 5' homology) was amplified from plasmid pAA296 using primers oAA2070 and oAA2075. The second DNA fragment (FAT1 3' homology) was amplified from plasmid pAA296 using primers oAA2074 and oAA2075. The third DNA fragment ($P_{URA3}URA3T_{URA3}P_{URA3}$) was amplified from plasmid pAA298 using primers oAA2072 and oAA2073. All three DNA fragments were combined in the same reaction to create a full-length deletion cassette by overlap extension PCR using primers oAA2070 and oAA2071. Strain sAA869 was transformed with the full-length deletion cassette and plated on SCD-URA plate. Several colonies were screened by PCR for integration of the deletion cassette at the second FAT1 allele. One such strain was named sAA875. Strain sAA875 was grown overnight in YPD media and then streaked on to 5-FOA containing plates. Single colonies were tested for URA3 reversion frequency, and the isolate with least reversion frequency was named sAA886.

Strain sAA2428 (ura3/ura3 pox4a::ura3/pox4b::ura3 pox5Δ::$T_{URA3}$/pox5Δ::$T_{URA3}$ faa1:$P_{URA3}$/faa1:$P_{URA3}$ fat1-Δ1::$P_{URA3}$/fat1-Δ2::$P_{URA3}$)

Strain sAA2428 was generated by knocking out both alleles of POX5 from the genome of the starting strain sAA886 (ura3/ura3 pox4a::ura3/pox4b::ura3 POX5/POX5 faa1::$P_{URA3}$/faa1:: $P_{URA3}$ fat1-Δ1::$P_{URA3}$/fat1-42::$P_{URA3}$) in a series of homologous recombination events as outlined in Table 7 above and described herein. Both POX5 alleles were disrupted by transforming the strain with the double-crossover knock out cassette from plasmid pAA918.

Knock out plasmid pAA918 (SEQ ID NO: 128) was constructed by combining DNA fragments containing POX5 5', POX5 3' and a URA3 marker gene. Approximately 600 bp of the 5' flanking region of the *Candida* strain ATCC 20336 POX5 gene was amplified from genomic DNA using oligos oAA2656 and oAA2657. This fragment was gel purified and cloned into a pCR-Blunt II-TOPO vector to create plasmid pAA494. Approximately 500 bp of the 3' flanking region of the POX5 gene was amplified with primers oAA2658 and oAA2659 using genomic DNA of *Candida* strain ATCC 20336 and this fragment was cloned into a pCR-Blunt II-TOPO vector to create plasmid pAA495. EcoRII/BamHI-digested fragment of pAA494, HindIII/BamHI fragment of pAA495 and HindIII/EcoRI fragment of pUC19 were ligated together to construct plasmid pAA496. Subsequently, a DNA fragment containing the $T_{URA3}P_{URA3}URA3T_{URA3}$ cassette flanked by NotI restriction sites was cloned into the NotI site of pAA496 to create the POX5 knockout construct plasmid pAA918 (FIG. 43). Strain sAA886 was transformed with PacI-digested fragment of pAA918 and plated on SCD-URA plate. Several colonies were screened by PCR for integration of the deletion cassette in the first POX5 allele. A positive colony was named sAA2291. Strain sAA2291 was grown in YPD media overnight and plated on a 5-FOA plate. Colonies that grew in the presence of 5-FOA were PCR screened for the looping out of the URA3 gene to leave behind only the URA3 terminator ($T_{URA3}$) in the first POX5 allele. This strain was named sAA2310. The deletion of the second POX5 allele was performed by transformation of PacI-digested fragment of pAA918 into sAA2310 and plating on a SCD-URA plate. Colonies that grew on the SCD-URA plate were PCR screened for integration of the knockout cassette in the second POX5 allele. A positive colony was named sAA2399. Strain sAA2399 was grown in YPD media overnight and plated on a 5-FOA plate. Colonies that grew in the presence of 5-FOA were PCR screened for the looping out of the URA3 gene to leave behind only the URA3 terminator ($T_{URA3}$) in the second POX5 allele. This strain was named sAA2428.

Strains sAA2570 and sAA2571

Host strains containing DNA encoding modified Pox5p enzymes were generated by transformation of strain sAA2428. Strains sAA2570 and sAA2571 were generated by transformation of sAA2428 with DNA encoding a modified Pox5p enzyme (Pox5p F98G) in which the codon for amino acid at position 98 in the protein is a glycine codon instead of the phenylalanine codon at position 98 in the wild-type Pox5p enzyme. Plasmid pAA1055, containing DNA encoding Pox5p (F98G) flanked by the POX4 promoter and terminator, and also containing a URA3 selectable marker, was digested with BstZ17I. The resulting linear DNA fragment was transformed into sAA2428. Transformants were selected by growth on SCD-URA plates. Clones that grew well on minimal media containing 0.1% Tween 80 and 0.1% oleic acid as the sole carbon source were then grown in shake flask fermentations and analyzed for dicarboxylic acid production. Two of the selected strains were sAA2570 and sAA2571.

Strains sAA2782, sAA2783 and sAA2784

Strains sAA2782, sAA2783 and sAA2784 were generated by transformation of sAA2428 with DNA encoding a modified Pox5p enzyme (Pox5p W429F) in which the codon for amino acid at position 429 in the protein is a phenylalanine codon instead of the tryptophan codon at position 429 in the wild-type Pox5p enzyme. Plasmid pAA1129, containing DNA encoding Pox5p (W429F) flanked by the POX4 promoter and terminator, and also containing a URA3 selectable marker, was digested with BstZ17I. The resulting linear DNA fragment was transformed into sAA2428. Transformants were selected by growth on SCD-URA plates. Clones that grew well on minimal media containing 0.1% Tween 80 and 0.1% oleic acid as the sole carbon source were then grown in shake flask fermentations and analyzed for fatty acid production. Three of the selected strains were sAA2782, sAA2783 and sAA2784.

Analysis of Adipic Acid Production by Strains sAA2570, sAA2571, sAA2782, sAA2783 and sAA2784

Host strains containing DNA encoding modified Pox5p enzymes were grown in shake flask fermentations on oleic acid and analyzed for production of fatty acids. Cultures (5 ml) of each strain that had been grown overnight in YPD medium to an initial $OD_{600\ nm}$ of 0.4 were used to inoculate 250-mL glass flasks containing 50 mL of SP92 media (6.7 g/L Difco yeast nitrogen base, 3.0 g/L Difco yeast extract, 3.0 g/L ammonium sulfate, 1.0 g/L potassium phosphate monobasic, 1.0 g/L potassium phosphate dibasic, 75 g/L glycerol). After 24 h incubation at 30° C. with shaking at 250 rpm (2" throw incubator) the cells were centrifuged and the cell pellet resuspended in 15 mL of HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L). The cultures were transferred to fresh 250-mL glass bottom-baffled flasks and 2% v/v oleic acid was added. Cultures were incubated at 30° C. with shaking at 300 rpm to start fatty acid production. Samples of culture broth were taken every 24 hours for gas chromatographic (GC) analysis to determine the diacid composition of the culture. The results of analyses of the host strains containing DNA encoding modified Pox5p enzymes were compared to those of a strain containing DNA encoding wild-type Pox5p (sAA875: pox4a::ura3/pox4b::ura3 POX5/POX5 faa1:: $P_{URA3}$/faa1::$P_{URA3}$ fat1-Δ1::$P_{URA3}$/fat1-Δ2::URA3).

The results of the gas chromatographic determinations of fatty acid content of the culture broth of shake flask fermentations comparing strains containing DNA encoding wild-type Pox5p to strains containing DNA encoding mutant Pox5p enzymes are provided in Table 8 and Table 9. The strains containing DNA encoding Pox5p mutants exhibited higher adipic acid (C6 diacid) selectivity, productivity, and yield.

TABLE 8

Comparison of Diacids in Culture Broth from 72-hour Shake Flask Cultures of Strains Expressing Wild-Type Pox5p and an F98G Mutant

| Strain name | Pox5p Acyl CoA-Oxidase | g/L C8 diacid | g/L C6 diacid (yield as % Ymax*) |
|---|---|---|---|
| sAA875 | Wild-type Pox5p | 3.93 | 10.66 (54) |
| sAA2570 | Pox5p F98G | 0.00 | 17.17 (78) |
| sAA2571 | Pox5p F98G | 0.00 | 15.50 (79) |

*Ymax is maximum theoretical yield. It is the amount of product that can be produced for a given biochemical pathway given a certain amount of consumed feedstock (i.e., grams adipic acid/grams oleic acid). The empirical yield is calculated by: mass of product produced divided by the mass of substrate consumed.

TABLE 9

Comparison of Diacids in Culture Broth from 72-hour Shake Flask Cultures of Strains Expressing Wild-Type Pox5p and a W429F Mutant

| Strain name | Pox5p Acyl CoA-Oxidase | g/L C8 diacid | g/L C6 diacid (yield as % Ymax) |
|---|---|---|---|
| sAA875 | Wild-type Pox5p | 5.75 | 8.80 (48) |
| sAA2782 | Pox5p W429F | 0.41 | 12.46 (67) |
| sAA2783 | Pox5p W429F | 0.62 | 13.24 (72) |
| sAA2784 | Pox5p W429F | 0.77 | 12.90 (71) |

Strain sAA2323 (ura3/ura3 pox4a::PEX11-$P_{URA3}$/Pox4b::PEX11-$P_{URA3}$ faa1:$P_{URA3}$/faa1:$P_{URA3}$ fat1,61::$P_{URA3}$/fat1-Δ2::$P_{URA3}$)

Strain sAA2323 was generated by integration of a double-crossover knock-in expression cassette containing nucleic acid encoding Candida strain ATCC 20336 Pex11p into both alleles of pox4 in the genome of the starting strain sAA886 in a series of successive double-crossover homologous recombination events as outlined in FIG. 41 and described herein. Integration of the expression cassette into each pox4 allele was accomplished by transforming the strain with a double-crossover knock-in cassette from plasmid pAA850.

A linear nucleic acid fragment containing a POX4 promoter-PEX11 ORF-POX4 terminator expression cassette, a URA3 selectable marker ($P_{URA3}$URA3$T_{URA3}P_{URA3}$) and a POX4 5' sequence on one end of the fragment and POX4 3' sequence on the other end of the fragment was amplified from plasmid pAA850 (FIG. 37) using primers oAA3355 and oAA3357. The linear nucleic acid fragment was used to chemically transform strain sAA886, and transformants were plated onto SCD-URA plates. The resultant colonies were streaked onto YPD for isolation and characterization. Colony PCR was performed to confirm the presence of the knock-in cassette and one isolate was saved as strain sAA2046 (ura3/ura3 pox4a::PEX11-URA3/pox4b::ura3 faa1:$P_{URA3}$/faa1::$P_{URA3}$ fat1-Δ1::$P_{URA3}$/fat1-Δ2::$P_{URA3}$).

Strain sAA2046 was grown overnight in YPD media and plated on 5-FOA plates. Colonies that grew in the presence of 5-FOA were PCR screened for the looping out of the URA3 gene leaving behind the URA3 promoter ($P_{URA3}$) and PEX11 gene in the first pox4 allele. The resultant strain was saved as strain sAA2122 (ura3/ura3 pox4a::PEX11-$P_{URA3}$/pox4b::ura3 faa1:$P_{URA3}$/faa1::$P_{URA3}$ fat1Δ1::$P_{URA3}$/fat1-Δ2::$P_{URA3}$).

A linear nucleic acid fragment amplified from plasmid pAA850 (FIG. 37) using primers oAA3355 and oAA3357 was also used to integrate the POX4 promoter-PEX11 ORF-POX4 terminator expression cassette into the second pox4 allele. Strain sAA2122 was chemically transformed with the linear nucleic acid, and transformants were plated onto SCD-URA plates. The resultant colonies were streaked onto YPD for isolation and characterization. Colony PCR was performed to confirm the presence of the knock-in cassette at both alleles and one isolate was saved as strain sAA2235 (ura3/ura3 pox4a::PEX11-$P_{URA3}$/pox4b::PEX11-URA3 faa1:$P_{URA3}$/faa1::$P_{URA3}$ fat1-Δ1::$P_{URA3}$/fat1-Δ2::$P_{URA3}$).

Strain sAA2235 was grown overnight in YPD media and plated on 5-FOA plates. Colonies that grew in the presence of 5-FOA were PCR screened for the looping out of the URA3 gene leaving behind the URA3 promoter ($P_{URA3}$) and PEX11 gene in the second pox4 allele. The resultant strain was saved as strain sAA2323 (ura3/ura3 pox4a::PEX11-$P_{URA3}$/poX4b::PEX11-$P_{URA3}$faa1:$P_{URA3}$/faa1:$P_{URA3}$ fat1-Δ1::$P_{URA3}$/fat1-Δ2::$P_{URA3}$).

Strain sAA2697 (ura3/ura3 pox4a::PEX11-$P_{URA3}$/pox4b::PEX11-$P_{URA3}$ faa1::CPRB-$P_{URA3}$/faa1::CPRB-$P_{URA3}$ fat1-Δ1::$P_{URA3}$/fat1-Δ2::$P_{URA3}$)

Strain sAA2697 was generated by integration of a double-crossover knock-in expression cassette containing nucleic acid encoding Candida ATCC 20336 strain CPRBp into both alleles of faa1 in the genome of the starting strain sAA2323 in a series of successive double-crossover homologous recombination events as outlined in FIG. 41 and described herein. Integration of the expression cassette into each faa1 allele was accomplished by transforming the strain with the plasmid construct pAA879.

A linear nucleic acid fragment containing a POX4 promoter-CPRB ORF-POX4 terminator expression cassette, a URA3 selectable marker ($P_{URA3}$URA3$T_{URA3}P_{URA3}$) and an FAA1 5' sequence on one end of the fragment and FAA1 3' sequence on the other end of the fragment was amplified from plasmid pAA879 (FIG. 35) using primers oAA3557 and oAA3564. The linear nucleic acid fragment was used to chemically transform strain sAA2323, and transformants were plated onto SCD-URA plates. The resultant colonies were streaked onto YPD for isolation and characterization. Colony PCR was performed to confirm the presence of the knock-in cassette and one isolate was saved as strain sAA2404 (ura3/ura3 pox4a::PEX11-$P_{URA3}$/pox4b::PEX11-$P_{URA3}$ faa1::CPRB-URA3/faa1::$P_{URA3}$ fat1-Δ1::$P_{URA3}$/fat1-Δ2::$P_{URA3}$). Strain sAA2404 was grown overnight in YPD media and plated on 5-FOA plates. Colonies that grew in the presence of 5-FOA were PCR screened for the looping out of the URA3 gene leaving behind the URA3 promoter ($P_{URA3}$) and CPRB gene in the first FAA1 allele. The resultant strain was saved as strain sAA2539 (ura3/ura3 pox4a::PEX11-$P_{URA3}$/pox4b::PEX11-$P_{URA3}$ faa1:CPRB-$P_{URA3}$/faa1:$P_{URA3}$ fat1-Δ1::$P_{URA3}$/fat1-Δ2::$P_{URA3}$).

A linear nucleic acid fragment amplified from plasmid pAA879 (FIG. 35) using primers oAA3557 and oAA3564 was also used to integrate the POX4 promoter-CPRB ORF-POX4 terminator expression cassette into the second faa1 allele. Strain sAA2539 was chemically transformed with the linear nucleic acid, and transformants were plated onto SCD-URA plates. The resultant colonies were streaked onto YPD for isolation and characterization. Colony PCR was performed to confirm the presence of the knock-in cassette at both alleles and one isolate was saved as strain sAA2622

(ura3/ura3 pox4a::PEX11-P$_{URA3}$/pox4b::PEX11-P$_{URA3}$ faa1::CPRB-P$_{URA3}$/faa1::CPRB-URA3 fat1-Δ1::P$_{URA3}$/fat1-Δ2::P$_{URA3}$).

Strain sAA2622 was grown overnight in YPD media and plated on 5-FOA plates. Colonies that grew in the presence of 5-FOA were PCR screened for the looping out of the URA3 gene leaving behind the URA3 promoter (P$_{URA3}$) and CPRB gene in the second FAA1 allele. The resultant strain was saved as strain sAA2697 (ura3/ura3 pox4a::PEX11-P$_{URA3}$/pox4b::PEX11-P$_{URA3}$ faa1:CPRB-P$_{URA3}$/faa1:CPRB-P$_{URA3}$ fat1-Δ1::P$_{URA3}$/fat1-Δ2::P$_{URA3}$).

Strain sAA2800 (ura3/ura3 pox4a::PEX11-P$_{URA3}$/pox4b::PEX11-P$_{URA3}$ faa1::CPRB-P$_{URA3}$/faa1::CPRB-P$_{URA3}$ fat1-Δ1::P$_{URA3}$/fat1-Δ2::P$_{URA3}$ pox5Δ::T$_{URA3}$/POX5Δ:: T$_{URA3}$)

Strain sAA2800 was generated by knocking out both alleles of POX5 from the genome of the starting strain sAA2697 in a series of successive double-crossover homologous recombination events as outlined in FIG. 41 and described herein. Both POX5 alleles were disrupted by transforming the strain with the double-crossover knock-out cassette from plasmid pAA918.

A linear nucleic acid fragment containing a URA3 selectable marker (T$_{URA3}$P$_{URA3}$URA3T$_{URA3}$) and a POX5 5' sequence on one end of the fragment and POX5 3' sequence on the other end of the fragment was obtained by cutting plasmid pAA918 (FIG. 43) with PacI and gel purifying the 2,893-bp DNA cassette. The linear nucleic acid fragment was used to chemically transform strain sAA2697, and transformants were plated onto SCD-URA plates. The resultant colonies were streaked onto YPD for isolation and characterization. Colony PCR was performed to confirm the presence of the knock-out cassette and one isolate was saved as strain sAA2704 (ura3/ura3 pox4a::PEX11-P$_{URA3}$/pox4b:: PEX11-P$_{URA3}$ faa1::CPRB-P$_{URA3}$/faa1::CPRB-P$_{URA3}$ fat1-Δ1::P$_{URA3}$/fat1-Δ2::P$_{URA3}$ pox5Δ::URA3/POX5).

Strain sAA2704 was grown overnight in YPD media and plated on 5-FOA plates. Colonies that grew in the presence of 5-FOA were PCR screened for the looping out of the URA3 gene leaving behind the URA3 terminator (T$_{URA3}$) in the first POX5 allele. The resultant strain was saved as strain sAA2739 (ura3/ura3 pox4a::PEX11-P$_{URA3}$/pox4b::PEX11-P$_{URA3}$ faa1::CPRB-P$_{URA3}$/faa1::CPRB-P$_{URA3}$ fat1-Δ1::P$_{URA3}$/fat1-Δ2::P$_{URA3}$ pox5Δ::T$_{URA3}$/POX5).

The knock-out of the second POX5 allele was performed by chemical transformation of strain sAA2739 with a double-crossover knock-out cassette generated by cutting plasmid pAA918 (FIG. 43) with PacI and gel purifying the 2,893-bp DNA cassette. The transformation reaction was plated onto SCD-URA plates. The resultant colonies were streaked onto YPD for isolation and characterization. Colony PCR was performed to confirm the presence of the knock-out cassette at both alleles and one isolate was saved as strain sAA2748 (ura3/ura3 pox4a::PEX11-P$_{URA3}$/pox4b:: PEX11-P$_{URA3}$ faa1::CPRB-P$_{URA3}$/faa1::CPRB-P$_{URA3}$ fat1-Δ1::P$_{URA3}$/fat1-Δ2::P$_{URA3}$ pox5Δ::T$_{URA3}$/pox5Δ::URA3).

Strain sAA2748 was grown overnight in YPD media and plated on 5-FOA plates. Colonies that grew in the presence of 5-FOA were PCR screened for the looping out of the URA3 gene leaving behind the URA3 terminator (T$_{URA3}$) in the second POX5 allele. The resultant strain was saved as strain sAA2800 (ura3/ura3 pox4a::PEX11-P$_{URA3}$/pox4b:: PEX11-P$_{URA3}$ faa1::CPRB-P$_{URA3}$/faa1::CPRB-P$_{URA3}$ fat1-Δ1::P$_{URA3}$/fat1-Δ2::P$_{URA3}$ pox5Δ::T$_{URA3}$/pox5Δ:: T$_{URA3}$).

Strain sAA3656 (ura3/ura3 pox4a::PEX11-P$_{URA3}$/pox4b:: PEX11-P$_{URA3}$ faa1::CPRB-P$_{URA3}$/faa1::CPRB-P$_{URA3}$ fat1-Δ1::P$_{URA3}$/fat1-Δ2::P$_{URA3}$ pox5Δ::T$_{URA3}$/POX5Δ:: T$_{URA3}$_pxa1-Δ1::P$_{URA3}$/Pxa1-Δ2::P$_{URA3}$)

Strain sAA3656 was generated by disrupting both alleles of PXA1 in the genome of the starting strain sAA2800 (ura3/ura3 pox4a::PEX11-P$_{URA3}$/pox4b::PEX11-P$_{URA3}$ faa1::CPRB-P$_{URA3}$/faa1::CPRB-P$_{URA3}$ fat1-Δ1::P$_{URA3}$/fat1-Δ2::P$_{URA3}$ pox5Δ::T$_{URA3}$/pox5Δ::T$_{URA3}$) in a series of successive double-crossover homologous recombination events as outlined in FIG. 41 and described herein. Both PXA1 alleles were disrupted by transforming the strain with the double-crossover knock-out cassettes from plasmids pAA1117 and pAA1155.

A linear nucleic acid fragment containing a URA3 selectable marker (P$_{URA3}$URA3T$_{URA3}$P$_{URA3}$) and a PXA1 5' sequence on one end of the fragment and PXA1 3' sequence on the other end of the fragment was amplified from plasmid pAA1117 (FIG. 40) using primers oAA2679 and oAA2684. The linear nucleic acid fragment was used to chemically transform strain sAA2800, and transformants were plated onto SCD-URA plates. The resultant colonies were streaked onto YPD for isolation and characterization. Colony PCR was performed to confirm the presence of the knock-out cassette and one isolate was saved as strain sAA3467 (ura3/ura3 pox4a::PEX11-P$_{URA3}$/pox4b::PEX11-P$_{URA3}$ faa1::CPRB-P$_{URA3}$/faa1::CPRB-P$_{URA3}$ fat1-Δ1::P$_{URA3}$/fat1-Δ2::P$_{URA3}$ pox5Δ::T$_{URA3}$/pox5Δ::T$_{URA3}$ pxa1-Δ1::URA3/PXA1).

Strain sAA3467 was grown overnight in YPD media and plated on 5-FOA plates. Colonies that grew in the presence of 5-FOA were PCR screened for the looping out of the URA3 gene leaving behind the URA3 promoter (P$_{URA3}$) in the first PXA1 allele. The resultant strain was saved as strain sAA3522 (ura3/ura3 pox4a::PEX11-P$_{URA3}$/pox4b::PEX11-P$_{URA3}$ faa1::CPRB-P$_{URA3}$/faa1::CPRB-P$_{URA3}$ fat1-Δ1::P$_{URA3}$/fat1-Δ2::P$_{URA3}$ pox5Δ::T$_{URA3}$/POX5Δ::T$_{URA3}$ pxa1-Δ1::P$_{URA3}$/PXA1).

The knock-out of the second PXA1 allele was performed by chemical transformation of strain sAA3522 with a double-crossover knock-out cassette generated by PCR with primers oAA2914 and oAA2919 and plasmid pAA1155 (FIG. 40) as template. The transformation reaction was plated onto SCD-URA plates. The resultant colonies were streaked onto YPD for isolation and characterization. Colony PCR was performed to confirm the presence of the knock-out cassette at both alleles and one isolate was saved as strain sAA3584 (ura3/ura3 pox4a::PEX11-P$_{URA3}$/pox4b:: PEX11-P$_{URA3}$ faa1::CPRB-P$_{URA3}$/faa1::CPRB-P$_{URA3}$ fat1-Δ1::P$_{URA3}$/fat1-Δ2::P$_{URA3}$ pox5Δ::T$_{URA3}$/POX5Δ::T$_{URA3}$ pxa1-Δ1::P$_{URA3}$/pxa1-Δ2::URA3).

Strain sAA3584 was grown overnight in YPD media and plated on 5-FOA plates. Colonies that grew in the presence of 5-FOA were PCR screened for the looping out of the URA3 gene leaving behind the URA3 promoter (P$_{URA3}$) in the second PXA1 allele. The resultant strain was saved as strain sAA3656 (ura3/ura3 pox4a::PEX11-P$_{URA3}$/pox4b:: PEX11-P$_{URA3}$ faa1::CPRB-P$_{URA3}$/faa1::CPRB-P$_{URA3}$ fat1-Δ1::P$_{URA3}$/fat1-Δ2::P$_{URA3}$ pox5Δ::T$_{URA3}$/POX5Δ::T$_{URA3}$ pxa1-Δ1::P$_{URA3}$/pxa1-Δ2::P$_{URA3}$).

Example 15: Analysis of the Growth of Cells and Organisms

As described herein, modified organisms developed using compositions and methods provided herein were analyzed for growth in different media. The analysis method was generally carried out as follows. Overnight cultures of engineered transformant strains, as well as control strains, were grown in YPD medium at 30° C. with shaking at 250 rpm. The OD$_{600\ nm}$ of the overnight cultures was measured and the cultures were normalized to an $OD_{600\ nm}$ of 0.1 by dilution with sterile water in sterile 1.5 mL tubes. A serial dilution of the normalized cultures was prepared in 96-well microtiter plates by transferring 250 microliters of normalized cultures into a column 1 well and 200 microliters of water into wells of columns 2 through 6. Using a multi-channel pipet, 50 microliters of normalized culture from a column 1 well was transferred to a column 2 well and pipetted up and down to mix. Then 50 microliters of the suspension in a column 2 well was transferred to a column 3 well and pipetted up and down to mix. This process was repeated for successive columns ending at column 6. Finally, 50 microliters of suspension from the column 6 well was removed and discarded, leaving 200 microliters in all wells. A sterile stamp tool formatted for use with 96 well plates was dipped into the 96 well plate containing the culture serial dilution and the adhering hanging drops were transferred to agar plates containing growth medium. The stamping was repeated for all growth medium plates desired. After allowing the transferred liquid to soak into the plates, they were incubated at 30° C. for 1 to 5 days and inspected for growth.

Example 16: Generation of Cells and Organisms Expressing Modified Carnitine Acetyltransferase In one embodiment, increased carnitine O-acetyltransferase activity can be obtained by increasing the amount of carnitine O-acetyltransferase enzyme in the cytosol. For example, engineered carnitine O-acetyltransferase proteins lacking amino acid sequence targeting signals that direct the enzyme to one or more cellular locations (e.g., peroxisomes and mitochondria) other than the cytoplasm can be expressed in host cells in one method of increasing the amount of carnitine O-acetyltransferase in the cytoplasm. Such modified carnitine O-acetyltransferases can be produced upon expression of heterologous nucleic acids encoding the proteins that have been introduced into host cells. In some embodiments, carnitine O-acetyltransferase activity can be decreased in particular cellular locations. For example, host cells that have been modified to knock out endogenous carnitine acetyltransferase activity in mitochondria and peroxisomes can be transformed with nucleic acid encoding carnitine O-acetyltransferases that are less enzymatically active than the endogenous enzyme that target the protein to a particular cellular location(s) (e.g., mitochondria) other than the cytoplasm.

Generation of CAT2 Knock-Out Strains

Generation of cells in which endogenous CAT2 genes are disrupted can be accomplished, for example, by successive double-crossover homologous recombination events using gene disruption methods known in the art and/or described herein. In one embodiment, the host is a strain of the yeast *Candida* that contains two alleles of the CAT2 gene. The effective deletion via disruption of the first CAT2 allele was performed using a double-crossover knock-out cassette that both deleted a portion of the CAT2 coding region and disrupted the gene with a URA3 selectable marker. A double-crossover knock-out cassette was obtained by PCR amplification of plasmid pAA1519 (FIG. 24) with primers oAA2372 and oAA2377. The PCR product was purified and chemically transformed into *Candida* strain ATCC 20913 (a Ura⁻ version of *Candida* strain ATCC 20336) and the cells were grown on plates containing synthetic complete media supplemented with dextrose and lacking uracil (SCD-URA) to select for cells that incorporated the URA3-containing deletion cassette. The resultant colonies were streaked onto SCD-URA for isolation and characterization. PCR of genomic DNA was performed to confirm the presence of the deletion cassette, and two isolates (ura3/ura3 cat2-Δ1:: URA3/CAT2) were saved as sAA4477 and sAA4478.

In order to generate a uracil auxotrophic version of strain sAA4477 that could be used as a host to disrupt the second CAT2 gene allele using uracil-based selection techniques, sAA4477 was grown overnight in YPD media and plated on plates containing 5-fluoroorotic acid (5-FOA). 5-FOA is a compound that is metabolized by URA3 cells into a chemical that is toxic to the cells and causes cell death. Growth of cells containing the $P_{URA3}URA3T_{URA3}P_{URA3}$ cassette from pAA1519, such as sAA4477 cells, on 5-FOA promotes recombination between the homologous $P_{URA3}$ sequences of the cassette resulting in "looping out" of the functional URA3 gene and cells that are able to survive in the presence of 5-FOA. Colonies that grew in the presence of 5-FOA were PCR screened for the looping out of the URA3 gene leaving behind only the URA3 promoter ($P_{URA3}$) in the first CAT2 allele. Two isolates with the correct construction (ura3/ura3 cat2-Δ1::$P_{URA3}$/CAT2) were saved as sAA4551 and sAA4552.

The deletion of the second CAT2 allele was performed using a double-crossover knock-out cassette that both deleted a portion of the CAT2 coding region and disrupted the gene with a URA3 selectable marker. Plasmid pAA1520 (FIG. 24) was PCR amplified with primers oAA2372 and oAA2377. The PCR product was purified and chemically transformed into strain sAA4551 and the cells were plated onto SCD-URA plates. The resultant colonies were streaked onto SCD-URA for isolation and characterization. PCR of genomic DNA was performed to confirm the presence of the deletion cassette and two isolates (ura3/ura3 cat2-Δ1:: $P_{URA3}$/cat2-Δ2:: URA3) were saved as sAA4594 and sAA4595.

In order to generate a Ura⁻ version of strain sAA4594 that could be used as a host to disrupt and/or introduce additional genes using uracil-based selection techniques, strain sAA4594 was grown overnight in YPD media and plated on 5-FOA plates. Colonies that grew in the presence of 5-FOA were PCR screened for the looping out of the URA3 gene leaving behind only the URA3 promoter ($P_{URA3}$) in the second CAT2 allele. Two isolates with the correct construction (ura3/ura3 cat2-Δ1::$P_{URA3}$/cat2-Δ2::$P_{URA3}$) were saved as sAA4625 and sAA4626. Strains sAA4625 and sAA4626 have both CAT2 alleles effectively deleted due to their disruption by the presence of the URA3 promoter ($P_{URA3}$) at different positions of each CAT2 allele.

Generation of Strains Containing Nucleic Acids Encoding Modified Cat2p

Yeast strains containing nucleic acids encoding modified Cat2 proteins lacking peroxisomal and/or mitochondrial targeting sequences were generated by transformation of a Cat2⁻ strain sAA4625 with nucleic acid encoding Cat2p$^{\Delta mts}$, Cat2p$^{\Delta pts}$ or nucleic acid encoding Cat2p$^{\Delta mts \Delta pts}$. Plasmid pAA1610 containing nucleic acid encoding the modified Cat2p$^{\Delta mts}$ protein under the control of the HDE1 gene promoter and POX4 gene terminator positioned between two separate fragments of the URA3 gene selectable marker was PCR amplified with primers oAA2206 and oAA2209. The PCR product was purified and chemically transformed into strain sAA4625 and the cells were grown on SC-URA plates. The resultant colonies were restreaked onto YPD for isolation and characterization. PCR of genomic DNA was performed to confirm the presence of the cassette, and an isolate was analyzed for growth as described herein.

Plasmid pAA1876 containing nucleic acid encoding the modified Cat2p$^{\Delta pts}$ protein under the control of the HDE1 gene promoter and POX4 gene terminator positioned between the two separate fragments of the URA3 gene selectable marker was PCR amplified with primers oAA2206 and oAA2209. The PCR product was purified and chemically transformed into strain sAA4625 and the cells were grown on SC-URA plates. The resultant colonies were restreaked onto YPD for isolation and characterization. PCR of genomic DNA was performed to confirm the presence of the cassette, and an isolate was analyzed for growth as described herein.

Example 17: Generation of Cells and Organisms Expressing a Modified Mitochondrial Carnitine Acetyltransferase As described in the following Example of spot-growth assays of yeast expressing modified carnitine acetyltransferase proteins, transformation of a Cat2⁻ strain of Candida with nucleic acid encoding Cat2p$^{\Delta mts}$, which lacks a mitochondrial targeting sequence (MTS) but retains an intact peroxisomal targeting sequence (PTS) for targeting the enzyme to the peroxisome, was not sufficient to rescue the growth deficiency of the Cat2⁻ strain when cultured using oleic acid as the sole carbon source. However, growth of the Cat2⁻ strain on oleic acid could be restored through expression of a mitochondrial-targeted enzyme with carnitine acetyltransferase activity in conjunction with expression of the Cat2$^{\Delta mts}$ mutant. The mitochondrial carnitine acetyltransferase enzyme could be engineered to have a low activity level to restore minimal growth on fatty acids and provide a bottleneck resulting in increased cytoplasmic acetyl-carnitine concentrations. In order to generate yeast strains having a reduced carnitine acetyltransferase activity in the mitochondria, Cat2⁻ strains were transformed with DNA encoding modified Yat1p enzymes. In wild-type Candida strain ATCC 20336, Yat1p, which has lower enzymatic activity than Cat2p, is localized to the cytoplasm. Therefore, to express the lower-activity carnitine acetyltransferase activity in the mitochondria, the Yat1p-encoding nucleic acid used in the transformation was modified to include nucleic acid encoding mitochondrial targeting sequences (MTS). The transforming DNA encoded the predicted MTS from the Cox4p, Cit1p or Cat2p proteins of Candida strain ATCC 20336 which was added to the 5' end of the DNA coding sequence of the YAT1 gene such that the resulting encoded proteins contained the heterologous MTS in place of the native Yat1p initiating methionine.

Plasmid pAA1967 containing nucleic acid encoding the modified YAT1p$^{+COX4mts}$ protein under the control of the HDE1 gene promoter and POX4 gene terminator positioned between the two separate fragments of the URA3 gene marker was PCR amplified with primers oAA2206 and oAA2209. The PCR product was purified and chemically transformed into Ura⁻,Cat2⁻ strain sAA4625 and the cells were grown on SC-URA plates. The resultant colonies were restreaked onto YPD for isolation and characterization. PCR of genomic DNA was performed to confirm the presence of the cassette, and an isolate was analyzed for growth as described herein. Plasmid pAA1968 containing nucleic acid encoding the modified YAT1p$^{+CIT1mts}$ protein under the control of the HDE1 gene promoter and POX4 gene terminator positioned between the two separate fragments of the URA3 gene marker was PCR amplified with primers oAA2206 and oAA2209. The PCR product was purified and chemically transformed into strain sAA4625 and the cells were grown on SC-URA plates. The resultant colonies were restreaked onto YPD for isolation and characterization. PCR of genomic DNA was performed to confirm the presence of the cassette, and an isolate was analyzed for growth as described herein.

Plasmid pAA1969 containing nucleic acid encoding the modified YAT1p$^{+CAT2mts}$ protein under the control of the HDE1 gene promoter and POX4 gene terminator positioned between the two separate fragments of the URA3 gene marker was PCR amplified with primers oAA2206 and oAA2209. The PCR product was purified and chemically transformed into strain sAA4625 and the cells were grown on SC-URA plates. The resultant colonies were restreaked onto YPD for isolation and characterization. PCR of genomic DNA was performed to confirm the presence of the cassette, and an isolate was analyzed for growth as described herein.

Example 18: Analysis of Organisms in which Carnitine Acetyltransferase Expression has been Modified Analysis of Strains Via Growth Assays Transformant strains engineered for modified carnitine acetyltransferase expression were cultured in control media and in media containing oleic acid and inspected for growth using methods described herein in a previous Example. As shown in FIG. 44, the wild-type strain ATCC 20336 containing two complete CAT2 genes was able to grow on the control plate containing synthetic complete media with dextrose minus uracil (SCD-URA) and on the fatty acid plate containing yeast nitrogen base without amino acids, plus phosphate and 2% oleic acid (YNBP+2% oleic acid). A Cat2⁻,Ura⁺ strain (cat2-Δ1::P$_{URA3}$/cat2-Δ2::URA3) sAA4594 was able to grow only on the control plate. The deletion of the CAT2 genes resulted in a mutant strain unable to grow on oleic acid as the sole carbon source. Spot growth assays of serial dilutions were used to evaluate the ability of a genetic construct encoding a Cat2p mutant to rescue the fatty acid growth deficiency of a Cat2⁻ strain. Transformation of a Ura3⁻,Cat2⁻ strain sAA4625 with a genetic construct containing nucleic acid encoding Cat2p$^{\Delta mts}$ and URA3 selectable marker (amplicon from PCR amplification of pAA1610 with primers oAA2206 and oAA2209) resulted in a strain able to grow on only the control plate. Transformation of a Ura3⁻, Cat2⁻ strain sAA4625 with a genetic construct containing nucleic acid encoding Cat2p$^{\Delta pts}$ and URA3 selectable marker (amplicon from PCR amplification of pAA1876 with primers oAA2206/oAA2209) resulted in strains (three different transformants designated as cat2-:: P$_{URA3}$/cat2-Δ2::P$_{URA3}$+pAA1876 in FIG. 44) able to grow on both the control and oleic acid plates. Removal of the N-terminal MTS from the Cat2p prevented targeting of the enzyme to the mitochondrial compartment thereby preventing conversion of acetyl-carnitine to acetyl-CoA in the mitochondria and preventing growth on oleic acid. However, removal of the type 1 PTS from the C-terminus of Cat2p did not affect the ability of the enzyme to restore growth on fatty acids to a Cat2⁻ strain. Without being limited or bound by theory, it is believed that the Cat2p$^{\Delta pts}$ is still targeted to the peroxisomal compartment via another mechanism and, with the intact MTS targeting it to the mitochondria, the Cat2p$^{\Delta pts}$ enzyme is able to restore growth on fatty acids.

Although expression of CAT2⁶mts, which includes nucleic acid encoding a peroxisomal targeting sequence, should result in a Cat2p$^{\Delta mts}$ that is targeted to peroxisomes, expression of CAT2$^{\Delta mts}$ alone was not sufficient to rescue the oleic acid growth deficiency in strains in which both CAT2 genes were disrupted. *Candida* Cat2⁻ deletion strains transformed with DNA encoding additional modified mitochondrial carnitine acetyltransferase enzymes were also tested for growth on oleic acid to further investigate whether growth on fatty acids is restored by a mitochondrial targeted enzyme in conjunction with Cat2p$^{\Delta mts}$. Growth of the Cat2⁻ strains on oleic acid was restored when a carnitine acetyl transferase enzyme (i.e., Yat1p) targeted to the mitochondria was expressed in cells in conjunction with expression of a peroxisomal-targeted Cat2p (encoded by CAT2$^{\Delta mts}$). A Ura3⁻, Cat2⁻ mutant sAA4625 was transformed with two separate DNA constructs: one containing a URA3 selectable marker and CAT2$^{\Delta mts}$ (an amplicon from PCR amplification of pAA1610 with primers oAA2206 and oAA2209) and another containing DNA encoding a Yat1p with the MTS of one of three different mitochondrial enzymes (Cox4p, Cit1p or Cat2p) fused to its N-terminus (three separate amplicons from PCR amplification of plasmids pAA1967, pAA1968 and pAA1969 with primers oAA2206 and oAA2209). Because the wild-type endogenous Yat1p is a cytoplasmic enzyme, DNA constructs pAA1967, pAA1968 and pAA1969 were engineered as described herein to encode Yat1p with an MTS from the Cox4p, Cit1p and Cat2p proteins, respectively, added to the N-terminus for mitochondrial targeting. As shown in FIG. 45, the co-transformation of a Cat2⁻ strain with DNA encoding Cat2p$^{\Delta mts}$ and a Yat1p$^{+mts}$ resulted in growth on both the control and oleic acid plates demonstrating a rescue of the fatty acid growth deficiency of a Cat2⁻ deletion strain. Some of the transformants displayed slower growth which may be related to copy number of the transformed genetic constructs that integrated into the host cell genome and/or to the lower activity level of Yat1p. As shown in these results, a mitochondrial-targeted carnitine acetyltransferase enzyme (a Yat1p$^{+mts}$), which has a decreased activity level compared to wild-type, endogenous Cat2p enzymes, could restore minimal growth on oleic acid to a Cat2⁻ *Candida* strain.

In Vitro Carnitine Acetyltransferase Enzyme Activity Assays

Wild-type control and transformant strains engineered for modified carnitine acetyltransferase expression can also be analyzed for total cellular carnitine acetyltransferase activity. Cells are grown for 48 hours in HiP-TAB medium (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) with 2% oleic acid. Approximately 100 mg of cells are harvested and washed with water then resuspended in 100 mM Tris-HCl, pH 8.0. Soluble cell extracts (in 100 mM Tris-HCl pH 8.0) are prepared by 3 rounds of bead beating cells using 1-minute pulses with 1-minute ice rests followed by pelleting insoluble debris at 13,000×g for 10 min at 4° C. The assay reaction mixture contains 0.18 mM coenzyme A, 5.6 mM acetyl-DL-carnitine, and 92 mM Tris-HCl pH 8.0 buffer. Reactions are carried out at 25° C. and enzyme activity is determined by monitoring an increase of absorption at 233 nm. One unit of activity represents the conversion of 1.0 µmole of acetyl-L-carnitine and CoA to L-carnitine and acetyl-coA per minute at pH 8.0 at 25° C.

Example 19: Generation of Cells and Organisms Expressing a Modified Acetyl Co-A Hydrolase, Acetyl-CoA Synthetase and/or Carnitine Acetyltransferase Peroxisomal beta-oxidation, which results in generation of acetyl Co-A and fatty acids, generally requires a supply of free coenzyme-A which, in a wild-type cell, can be supplied by peroxisomal Cat2p enzyme transferring acetyl units from acetyl-CoA to carnitine. Another enzyme for liberating coenzyme-A from acetyl-CoA is acetyl-CoA hydrolase (Ach1p). This enzyme can catalyze the conversion of acetyl-CoA to acetate. Because the Ach1p enzyme is targeted to the mitochondrial compartment in wild-type cells, engineering of Ach1p to reroute the enzyme to the peroxisome can involve removing the N-terminal mitochondrial targeting sequence (MTS) and adding a C-terminal peroxisomal targeting sequence (PTS) as described herein. The acetate produced in the peroxisomal compartment via the Ach1p reaction can diffuse out of the peroxisome into the cytoplasm where it can be converted back to acetyl-CoA by cytosolic acetyl-CoA synthetases (Acs1p, Acs2p), the expression of which can be amplified by increasing the copy number of ACS1/2p-encoding nucleic acids in cells and/or by replacing the promoter controlling transcription of the nucleic acids. Cytoplasmic acetyl-CoA can then be used in generating cytosolic malonyl-CoA and in fatty acid synthesis as described herein and/or converted to acetyl-carnitine by cytoplasmic Yat1p, transported into the mitochondria and converted back to acetyl-CoA by endogenous mitochondrial Cat2p or an engineered Yat1p with an added MTS expressed in mitochondria as also described herein.

A Ura3⁻,Cat2⁻ mutant strain sAA4625 of *Candida* was transformed with DNA constructs containing a URA3 selectable marker, ACH1$^{\Delta mts+Pts}$ encoding an Ach1p lacking an MTS and containing an added PTS, ACS1, ACS2, and YAT1$^{+mts}$ encoding a Yat1p containing an added MTS from either Cox4p, Cit1p or Cat2p fused to the N-terminus as follows. All transformation cassettes were generated by PCR amplification from their respective plasmids (plasmids pAA1846, pAA1847, pAA1875, pAA1967, pAA1968 and pAA1969) using primers oAA2206 and oAA2209 then purified before transformation. Transformation reactions were plated on SC-URA to select for transformants that had integrated the DNA cassettes containing the URA3 selectable marker(s). Individual colonies were restreaked onto YPD plates for isolation prior to further use.

Example 20: Analysis of Organisms in which Acetyl Co-A Hydrolase Expression has been Modified To assess the growth capabilities of strains transformed with DNA encoding a modified Ach1p, the strains were analyzed in spot growth assays (using assay methods described herein in a previous Example) and the results were compared to the growth of control strains. A Ura3⁻,Cat2⁻ *Candida* strain sAA4625 was transformed with DNA constructs containing a URA3 selectable marker, ACH1$^{\Delta mts+pts}$ encoding an Ach1p lacking an MTS and containing an added PTS, ACS1, ACS2, and YAT1$^{+mts}$ encoding a Yat1p containing an added MTS from either Cox4p, Cit1p or Cat2p fused to the N-terminus. As shown in FIG. 46, although the control Cat2⁻ deletion strain was unable to grow on oleic acid, the strain co-transformed with ACH1$^{\Delta mts+pts}$, ACS1 and/or ACS2, and YAT1$^{+mts}$ resulted in growth on both the control (SCD-URA) and oleic acid plates demonstrating a rescue of the fatty acid growth deficiency of the Cat2⁻ mutant. These results demonstrated that carbon from peroxisomal beta-oxidation could be rerouted to the cytoplasmic compartment in modified host cells.

Example 21: Generation of Cells and Organisms Expressing Heterologous Nucleic Acids for Modified Expression of Acetyl-Carnitine Transport Proteins, Thioesterase, Carnitine Acetyltransferase and Acetyl-CoA Carboxylase Recombinant microorganisms were developed for modified expression of acetyl-carnitine transport proteins, thioesterase, carnitine acetyltransferase and acetyl-CoA carboxylase through transformation with heterologous nucleic acids as described herein. The cells used in the development of these microorganisms were uracil auxotrophs in which multiple genes (e.g., CRC1, POX4, FAA1, FAT1, PXA1) had been disrupted and the expression of multiple proteins (e.g., Pox5p, Pex11p, CPRBp, P450A17p) had been amplified and/or altered for increased activity of the proteins (e.g., enzymes). In one example, Candida host yeast cells in which the endogenous CRC1 genes had been disrupted were used in the development of the modified recombinant microorganisms.

Generation of CRC1 Knock-Out Strains

Generation of cells in which endogenous CRC1 genes are disrupted can be accomplished, for example, by double-crossover homologous recombination events using gene disruption methods known in the art and/or described herein. In one embodiment, the host is a strain of the yeast Candida that contains two alleles of the CRC1 gene.

Generation of CRC1 Deletion Strain sAA9426

The effective deletion via disruption of the first CRC1 allele was performed using a cassette that both deleted a portion of the CRC1 coding region and disrupted the gene with a URA3 selectable marker containing a $P_{URA3}$ repeat ($P_{URA3}$URA3$T_{URA3}P_{URA3}$). The linear DNA construct for transformation was PCR amplified from plasmid pAA1613 (FIG. 32) with primers oAA5511 and oAA5512. The PCR product was purified and chemically transformed into Candida strain ATCC 20913 (a Ura⁻ derivative of Candida strain ATCC 20336) and the cells were plated onto SCD-URA plates. The resultant colonies were streaked onto YPD for isolation and characterization. Colony PCR was performed to confirm the presence of the deletion cassette and one isolate was saved as strain sAA4368 (ura3/ura3 crc1-Δ1::URA3/CRC1).

Strain sAA4368 was grown overnight in YPD media and plated on 5-FOA plates. Colonies that grew in the presence of 5-FOA were PCR screened for the looping out of the URA3 gene leaving behind only the URA3 promoter ($P_{URA3}$) in the first CRC1 allele. The resultant strain was saved as strain sAA4388 (ura3/ura3 crc1-Δ1::$P_{URA3}$/CRC1).

The deletion of the second CRC1 allele was performed using a cassette that deleted a shorter portion of the CRC1 coding region than the first allele disruption cassette and disrupted the gene with a URA3 selectable marker containing a $P_{URA3}$ repeat ($P_{URA3}$URA3$T_{URA3}P_{URA3}$). The linear DNA construct for transformation was PCR amplified from plasmid pAA1701 (FIG. 32) with primers oAA5511 and oAA5512. The PCR product was purified and chemically transformed into strain sAA4388 and the cells were plated onto SCD-URA plates. The resultant colonies were streaked onto YPD for isolation and characterization. Colony PCR was performed to confirm the presence of the deletion cassette and one isolate was saved as strain sAA9398 (ura3/ura3 crc1-Δ1::$P_{URA3}$/crc1-Δ2::URA3).

Strain sAA9398 was grown overnight in YPD media and plated on 5-FOA plates. Colonies that grew in the presence of 5-FOA were PCR screened for the looping out of the URA3 gene leaving behind only the URA3 promoter ($P_{URA3}$) in the second CRC1 allele. The resultant strain was saved as strain sAA9426 (ura3/ura3 crc1-Δ1::$P_{URA3}$/crc1-Δ2::$P_{URA3}$). Table 10 summarizes the steps, intermediate strains and genotypes in the development of strain sAA9426.

TABLE 10

Yeast strain genotypes and steps in constructing sAA9426

| Name | Ura3+/− | Plasmid | Genotype |
|---|---|---|---|
| ATCC 20913 | − | NA | ura3/ura3 |
| sAA4368 | + | pAA1613 | ura3/ura3 crc1-Δ1::URA3/CRC1 |
| sAA4388 | − | NA | ura3/ura3 crc1-Δ1::$P_{URA3}$/CRC1 |
| sAA9398 | + | pAA1701 | ura3/ura3 crc1-Δ1::$P_{URA3}$/crc1-Δ2::URA3 |
| sAA9426 | − | NA | ura3/ura3 crc1-Δ1::$P_{URA3}$/crc1-Δ2::$P_{URA3}$ |

Generation of CRC1 Deletion Strain sAA4377

The effective deletion via disruption of the first CRC1 allele was performed using a cassette that both deleted a portion of the CRC1 coding region and disrupted the gene with a URA3 selectable marker containing a $P_{URA3}$ repeat ($P_{URA3}$URA3$T_{URA3}P_{URA3}$). The linear DNA construct for transformation was PCR amplified from plasmid pAA1613 (FIG. 32) with primers oAA5511 and oAA5512. The PCR product was purified and chemically transformed into strain sAA886 (ura3/ura3 pox4a::ura3/pox4b::ura3 faa1:$P_{URA3}$/faa1:$P_{URA3}$ fat1-Δ1::$P_{URA3}$/fat1-Δ2::$P_{URA3}$), which was developed through a series of homologous recombination steps from Candida strain ATCC 20962 (sAA003) as described herein, and the cells were plated onto SCD-URA plates. The resultant colonies were streaked onto YPD for isolation and characterization. Colony PCR was performed to confirm the presence of the deletion cassette and one isolate was saved as strain sAA4057 (ura3/ura3 pox4a::ura3/pox4b::ura3 faa1::$P_{URA3}$/faa1::$P_{URA3}$ fat1-Δ1::$P_{URA3}$/fat1-Δ2::$P_{URA3}$ crc1-Δ1::URA3/CRC1).

Strain sAA4057 was grown overnight in YPD media and plated on 5-FOA plates. Colonies that grew in the presence of 5-FOA were PCR screened for the looping out of the URA3 gene leaving behind only the URA3 promoter ($P_{URA3}$) in the first CRC1 allele. The resultant strain was saved as strain sAA4096 (ura3/ura3 pox4a::ura3/pox4b::ura3 faa1::$P_{URA3}$/faa1::$P_{URA3}$ fat1-Δ1::$P_{URA3}$/fat1-Δ2::$P_{URA3}$ crc1-Δ1::$P_{URA3}$/CRC1).

The deletion of the second CRC1 allele was performed using a cassette that deleted a shorter portion of the CRC1 coding region than the first allele disruption cassette and disrupted the gene with a URA3 selectable marker containing a $P_{URA3}$ repeat ($P_{URA3}$URA3$T_{URA3}P_{URA3}$). The linear DNA construct for transformation was PCR amplified from plasmid pAA1701 (FIG. 32) with primers oAA5511 and oAA5512. The PCR product was purified and chemically transformed into strain sAA4096 and the cells were plated onto SCD-URA plates. The resultant colonies were streaked onto YPD for isolation and characterization. Colony PCR was performed to confirm the presence of the deletion cassette and one isolate was saved as strain sAA4281 (ura3/ura3 pox4a::ura3/pox4b::ura3 faa1::$P_{URA3}$/faa1::$P_{URA3}$ fat1-Δ1::$P_{URA3}$/fat1-Δ2::$P_{URA3}$ crc1-Δ1::$P_{URA3}$/crc1-Δ2::URA3).

Strain sAA4281 was grown overnight in YPD media and plated on 5-FOA plates. Colonies that grew in the presence of 5-FOA were PCR screened for the looping out of the URA3 gene leaving behind only the URA3 promoter ($P_{URA3}$) in the second CRC1 allele. The resultant strain was saved as strain sAA4377 (ura3/ura3 pox4a::ura3/pox4b::ura3 faa1:$P_{URA3}$/faa1:$P_{URA3}$ fat1-Δ1::$P_{URA3}$/fat1-Δ2::$P_{URA3}$ crc1-Δ1::$P_{URA3}$/crc1-Δ2::$P_{URA3}$). This CRC1 deletion strain contains mutations in the FAA1, FAT1, POX4 and URA3 genes that inactivate cytoplasmic acyl-CoA synthetases (Faa1p and Fat1p), which prevents free fatty acids in the cytoplasm from being reactivated to the acyl-CoA form, a peroxisomal acyl-CoA oxidase (Pox4p), which blocks break down of short-chain acyl-CoA in β-oxidation, and orotidine-5-phosphate decarboxylase, which results in uracil auxotro-

TABLE 11

Yeast strain genotypes and steps in constructing sAA4377

| Name | Ura3+/− | Plasmid | Genotype |
|---|---|---|---|
| sAA886 | − | NA | ura3/ura3 pox4a::ura3/pox4b::ura3 faa1::$P_{URA3}$/faa1::$P_{URA3}$ fat1-Δ1::$P_{URA3}$/fat1-Δ2::$P_{URA3}$ |
| sAA4057 | + | pAA1613 | ura3/ura3 pox4a::ura3/pox4b::ura3 faa1::$P_{URA3}$/faa1::$P_{URA3}$ fat1-Δ1::$P_{URA3}$/fat1-Δ2::$P_{URA3}$ crc1-Δ1::URA3/CRC1 |
| sAA4096 | − | NA | ura3/ura3 pox4a::ura3/pox4b::ura3 faa1::$P_{URA3}$/faa1::$P_{URA3}$ fat1-Δ1::$P_{URA3}$/fat1-Δ2::$P_{URA3}$ crc1-Δ1::$P_{URA3}$/CRC1 |
| sAA4281 | + | pAA1701 | ura3/ura3 pox4a::ura3/pox4b::ura3 faa1::$P_{URA3}$/faa1::$P_{URA3}$ fat1-Δ1::$P_{URA3}$/fat1-Δ2::$P_{URA3}$ crc1-Δ1::$P_{URA3}$/crc1-Δ2::URA3 |
| sAA4377 | − | NA | ura3/ura3 pox4a::ura3/pox4b::ura3 faa1::$P_{URA3}$/faa1::$P_{URA3}$ fat1-Δ1::$P_{URA3}$/fat1-Δ2::$P_{URA3}$ crc1-Δ1::$P_{URA3}$/crc1-Δ2::$P_{URA3}$ |

15

Generation of CRC1 Deletion Strain sAA6270

A CRC1 deletion strain was constructed in host strain sAA3656 (described in a previous Example) that had been modified for enhanced ω-oxidation and altered β-oxidation. The effective deletion via disruption of the first CRC1 allele was performed using a cassette that both deleted a portion of the CRC1 coding region and disrupted the gene with a URA3 selectable marker containing a $P_{URA3}$ repeat ($P_{URA3}$URA3$T_{URA3}P_{URA3}$). The linear DNA construct for transformation was PCR amplified from plasmid pAA1613 (FIG. 32) with primers oAA5511 and oAA5512. The PCR product was purified and chemically transformed into strain sAA3656 and the cells were plated onto SCD-URA plates. The resultant colonies were streaked onto YPD for isolation and characterization. Colony PCR was performed to confirm the presence of the deletion cassette and one isolate was saved as strain sAA6087 (ura3/ura3 pox4a::PEX11-$P_{URA3}$/pox4b::PEX11-$P_{URA3}$ faa1::CPRB-$P_{URA3}$/faa1::CPRB-$P_{URA3}$ fat1-Δ1::$P_{URA3}$/fat1-Δ2::$P_{URA3}$ pox5Δ::$T_{URA3}$/pox5Δ::$T_{URA3}$ pxa1-Δ1::$P_{URA3}$/pxa1-Δ2::$P_{URA3}$ crc1-Δ1::URA3/CRC1).

Strain sAA6087 was grown overnight in YPD media and plated on 5-FOA plates. Colonies that grew in the presence of 5-FOA were PCR screened for the looping out of the URA3 gene leaving behind only the URA3 promoter ($P_{URA3}$) in the first CRC1 allele. The resultant strain was saved as strain sAA6151 (ura3/ura3 pox4a::PEX11-$P_{URA3}$/pox4b::PEX11-$P_{URA3}$ faa1::CPRB-$P_{URA3}$/faa1::CPRB-$P_{URA3}$ fat1-Δ1::$P_{URA3}$/fat1-Δ2::$P_{URA3}$ pox5Δ::$T_{URA3}$/pox5Δ::$T_{URA3}$ pxa1-Δ1::$P_{URA3}$/pxa1-Δ2::$P_{URA3}$ crc1-Δ1::$P_{URA3}$/CRC1).

The deletion of the second CRC1 allele was performed using a cassette that deleted a shorter portion of the CRC1 coding region than the first allele disruption cassette and disrupted the gene with a URA3 selectable marker containing a $P_{URA3}$ repeat ($P_{URA3}$URA3$T_{URA3}P_{URA3}$). The linear DNA construct for transformation was PCR amplified from plasmid pAA1701 (FIG. 32) with primers oAA5511 and oAA5512. The PCR product was purified and chemically transformed into strain sAA6151 and the cells were plated onto SCD-URA plates. The resultant colonies were streaked onto YPD for isolation and characterization. Colony PCR was performed to confirm the presence of the deletion cassette and one isolate was saved as strain sAA6192 (ura3/ura3 pox4a::PEX11-$P_{URA3}$/pox4b::PEX11-$P_{URA3}$ faa1::CPRB-$P_{URA3}$/faa1::CPRB-$P_{URA3}$ fat1-Δ1::$P_{URA3}$/fat1-Δ2::$P_{URA3}$ pox5Δ::$T_{URA3}$/pox5Δ::$T_{URA3}$ pxa1-Δ1::$P_{URA3}$/pxa1-Δ2::$P_{URA3}$ crc1-Δ1::$P_{URA3}$/crc1-Δ2::URA3).

Strain sAA6192 was grown overnight in YPD media and plated on 5-FOA plates. Colonies that grew in the presence of 5-FOA were PCR screened for the looping out of the URA3 gene leaving behind only the URA3 promoter ($P_{URA3}$) in the second CRC1 allele. The resultant strain was saved as strain sAA6270 (ura3/ura3 pox4a::PEX11-$P_{URA3}$/pox4b::PEX11-$P_{URA3}$ faa1::CPRB-$P_{URA3}$/faa1::CPRB-$P_{URA3}$ fat1-Δ1::$P_{URA3}$/fat1-Δ2::$P_{URA3}$ pox5Δ::$T_{URA3}$/POX5Δ::$T_{URA3}$ pxa1-Δ1::$P_{URA3}$/pxa1-Δ2::$P_{URA3}$ crc1-Δ1::$P_{URA3}$/crc1-Δ2::$P_{URA3}$). This CRC1 deletion strain contains mutations in the FAA1, FAT1, POX4, POX5, PXA1 and URA3 genes that inactivate cytoplasmic acyl-CoA synthetases (thereby preventing free fatty acids in the cytoplasm from being reactivated to the acyl-CoA form), peroxisomal acyl-CoA oxidases (thereby blocking break down of acyl-CoA in β-oxidation), an ATP-binding cassette transporter (thereby blocking import of activated acyl-CoA into the peroxisomes) and orotidine-5-phosphate decarboxylase (resulting in uracil auxotrophy of the strain). Table 12 summarizes the steps, intermediate strains and genotypes in the development of strain sAA6270.

TABLE 12

Yeast strain genotypes and steps in constructing sAA6270

| Name | Ura3+/− | Plasmid | Genotype |
|---|---|---|---|
| sAA3656 | − | NA | ura3/ura3 pox4a::PEX11-$P_{URA3}$/pox4b::PEX11-$P_{URA3}$ faa1::CPRB-$P_{URA3}$/faa1::CPRB-$P_{URA3}$ fat1-Δ1::$P_{URA3}$/fat1-Δ2::$P_{URA3}$ pox5Δ::$T_{URA3}$/pox5Δ::$T_{URA3}$ pxa1-Δ1::$P_{URA3}$/pxa1-Δ2::$P_{URA3}$ |
| sAA6087 | + | pAA1613 | ura3/ura3 pox4a::PEX11-$P_{URA3}$/pox4b::PEX11-$P_{URA3}$ faa1::CPRB-$P_{URA3}$/faa1::CPRB-$P_{URA3}$ fat1-Δ1::$P_{URA3}$/fat1-Δ2::$P_{URA3}$ pox5Δ::$T_{URA3}$/pox5Δ::$T_{URA3}$ pxa1-Δ1::$P_{URA3}$/pxa1-Δ2::$P_{URA3}$ crc1-Δ1::URA3/CRC1 |
| sAA6151 | − | NA | ura3/ura3 pox4a::PEX11-$P_{URA3}$/pox4b::PEX11-$P_{URA3}$ faa1::CPRB-$P_{URA3}$/faa1::CPRB-$P_{URA3}$ fat1-Δ1::Pv/fat1-Δ2::$P_{URA3}$ pox5Δ::$T_{URA3}$/pox5Δ::$T_{URA3}$ pxa1-Δ1::$P_{URA3}$/pxa1-Δ2::$P_{URA3}$ crc1-Δ1::$P_{URA3}$/CRC1 |
| sAA6192 | + | pAA1701 | ura3/ura3 pox4a::PEX11-$P_{URA3}$/pox4b::PEX11-$P_{URA3}$ faa1::CPRB-$P_{URA3}$/faa1::CPRB-$P_{URA3}$ fat1-Δ1::$P_{URA3}$/fat1-Δ2::$P_{URA3}$ pox5Δ::$T_{URA3}$/pox5Δ::$T_{URA3}$ pxa1-Δ1::$P_{URA3}$/pxa1-Δ2::$P_{URA3}$ crc1-Δ1::$P_{URA3}$/crc1-Δ2::URA3 |

TABLE 12-continued

Yeast strain genotypes and steps in constructing sAA6270

| Name | Ura3+/− | Plasmid | Genotype |
| --- | --- | --- | --- |
| sAA6270 | − | NA | ura3/ura3 pox4a::PEX11-$P_{URA3}$/pox4b::PEX11-$P_{URA3}$ faa1::CPRB-$P_{URA3}$/faa1::CPRB-$P_{URA3}$ fat1-Δ1::$P_{URA3}$/fat1-Δ2::$P_{URA3}$ pox5Δ::$T_{URA3}$/pox5Δ::$T_{URA3}$ pxa1-Δ1::$P_{URA3}$/pxa1-Δ2::$P_{URA3}$ crc1-Δ1::$P_{URA3}$/crc1-Δ2::$P_{URA3}$ |

Analysis of CRC1 Deletion Strains

Growth Assays of CRC1 Deletion Strains

Transformant strains engineered for modified Crc1p expression were cultured in control media and in media containing oleic acid and inspected for growth using methods described herein in a previous Example. As shown in FIG. 47, yeast strains encoding at least one functional allele of CRC1 are able to grow on both control media (SCD-URA) and on the fatty acid media (YNBP+2% oleic acid). Yeast strains with both CRC1 alleles knocked out are able to grow on control media but not on fatty acid media, demonstrating the key function of the Crc1p inner mitochondrial acetyl-carnitine transporter in fatty acid metabolism. The effect of the double CRC1 knockout is demonstrated in two different genetic backgrounds. The single (sAA4368) and double (sAA9398) CRC1 knockouts were generated from Candida strain ATCC 20913 (a Ura⁻ derivative of Candida strain ATCC20336). The single (sAA4057) and double (sAA4281) CRC1 knockouts were generated from strain sAA875, which is a partially beta-oxidation blocked strain described in a previous Example. Included in the growth assay are yeast strains (sAA5916, sAA5917 and sAA5918) generated by transformation of a double-crossover integration cassette into sAA4377 (the Ura− derivative of sAA4281) that was targeted to IGR5 and contained a URA3 selectable marker and a CRC1 gene linked to a weak promoter. The weak promoters used were from the genes encoding glucose-6-phosphate isomerase (G6PI in sAA5916), mitochondrial copper and phosphate carrier (PIC2 in sAA5917), or high-affinity sulfate permease (SUL2 in sAA5918). The transformants with CRC1 driven by a weak promoter each contained one integrated copy of the double-crossover cassette. None of the weak promoters were sufficient, with one genomic copy, to drive the expression of enough CRC1 to rescue the growth defect of the parental strain on fatty acid media.

Generation of Strains sAA6317 and sAA6424-sAA6428 Expressing Heterologous Nucleic Acids for Modified Expression of Crc1p, Tes3p, Cat2p and Acc1p CRC1 deletion strain sAA6270 was used as a host strain in the development of recombinant yeast strains expressing heterologous nucleic acids for modified expression of acetyl-carnitine transport proteins (Crc1p), thioesterase (Tes3p), carnitine acetyltransferase (Cat2p) and acetyl-CoA carboxylase (Acc1p). The final recombinant strains contain DNA encoding: (1) Crc1p under the control of the glucose-6-phosphate isomerase (G6PI) promoter for reduced expression of Crc1p, (2) Tes3p$^{Δpts}$ under the control of the hydratase-dehydrogenase-epimerase (HDE) promoter to provide for thioesterase enzyme activity in the cytoplasm, (3) Cat2p$^{ΔmtsΔpts}$ under the control of the HDE promoter to provide for increased carnitine O-acetyltransferase activity in the cytoplasm, and (4) modified Acc1p (S1153Δ) under the control of the HDE promoter to provide for increased acetyl-CoA carboxylase activity in the cytoplasm. These heterologous nucleic acids are expressed in the genetic background of a host cell that has been modified to express heterologous DNA encoding a protein (Pox5p(F98G)) for increased selective peroxisomal acyl-CoA oxidase activity as well as proteins for increased cytochrome P450 reductase (CPRBp) and monooxygenase (P450A17p) activities and peroxisomal biogenesis (Pex11p) activity. The host cell has also been modified to decrease or eliminate expression of cytosolic acyl-CoA synthetase, Pox4p acyl-CoA oxidase and peroxisomal Pxa1p acyl-CoA transport protein.

Linear DNA cassettes were generated from plasmids pAA1667 ($P_{HDE1}$CAT2$^{ΔmtsΔpts}$ $T_{POX4}$, pAA1164 ($P_{HDE}$-POX5(F98G)$T_{POX4}$), pAA1609 ($P_{HDE1}$TES3$^{Δpts}T_{POX4}$), pAA1712 ($P_{HDE1}$P450A17$T_{POX4}$), and pAA2311 ($P_{G6PI}$CRC1$T_{POX4}$) by PCR amplification using primers oAA2206 and oAA2209. A linear DNA cassette was also generated from plasmid pAA1907 ($P_{HDE}$-ACC1 (S1153Δ)-$T_{PGK}$) by digestion with SpeI. The linear DNA cassettes were designed for homologous recombination into the host ura3 locus. The DNA cassettes were purified and chemically transformed together into strain sAA6270, which was then spread onto plates lacking uracil (SC-URA). The resultant colonies were streaked onto SC-URA plates for isolation and colony PCR was used to verify the presence of the transformed genes. Growth on YNBP+oleic acid plates was used to confirm integration of DNA encoding Crc1p and Pox5p (F98G) into the host genome. Strains confirmed to be URA⁺ and containing DNA encoding the recycling loop enzymes (Crc1p, Tes3p$^{Δpts}$, Cat2p$^{ΔmtsΔPts}$ and Acc1(S1153A)p) were selected and stocked as sAA6317, sAA6424, sAA6425, sAA6426, sAA6427, and sAA6428.

Diacid Production by Strains sAA6317 and sAA6424-sAA6428 from Oleic Acid in Shake Flasks Transformant strains were grown in shake flask fermentations of oleic acid and analyzed for production of fatty acids. Cultures (5 ml) of each strain were grown overnight in YPD medium and used to inoculate 250-mL glass flasks containing 50 mL of SP92 media to an initial OD$_{600\ nm}$ of 0.4 (SP92 media: 6.7 g/L Difco yeast nitrogen base, 3.0 g/L Difco yeast extract, 3.0 g/L ammonium sulfate, 1.0 g/L potassium phosphate monobasic, 1.0 g/L potassium phosphate dibasic, 75 g/L glycerol). After 24 h incubation at 30° C. with shaking at 250 rpm (2" throw incubator) the cells were centrifuged and the cell pellet resuspended in 15 mL of HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L). The cultures were transferred to fresh 250-mL glass bottom-baffled flasks and 2% v/v oleic acid was added. Cultures were incubated at 30° C. with shaking at 300 rpm to start fatty acid production. Samples of culture broth were taken every 24 hours for gas chromatographic (GC) analysis to determine the diacid composition of the culture broth. The results of analyses of the transformant strains were compared to those of control strain sAA5082. Strain sAA5082 was generated by transforming strain sAA3656 with antibiotic-free DNA cassettes amplified by PCR with primers oAA2206 and oAA2209 from plasmids pAA1164, pAA1712, pAA573, pAA1672 and pAA1763. Respectively, these plasmids contain DNA encoding Pox5p(F98G), P450A17, Zwf1p (a *Candida* strain ATCC 20336 glucose-6-phosphate dehydrogenase), and Idp2p and Idp1p$^{\Delta mts}$ (both a *Candida* strain ATCC 20336 isocitrate dehydrogenase). Nucleic acids encoding Pox5p (F98G) and P450A17 are under the control of the HDE1 promoter and POX4 terminator. Nucleic acids encoding Idp2p and Idp1p$^{\Delta mts}$ are under the control of the promoter and terminator of *Candida* strain ATCC 20336 SPS19 gene (encoding peroxisomal 2,4-dienoyl-CoA reductase). DNA encoding Zwf1p is under the control of the *Candida* strain ATCC 20336 POX4 promoter and terminator. Strain sAA5082 does not contain genetic modifications for rerouting acetyl-CoA (i.e., DNA encoding the recycling loop enzymes Crc1p, Tes3p$^{\Delta pts}$, Cat2p$^{\Delta mts\Delta pts}$ and Acc1(S1153A) p); however, it does contain modified genes for the expression of enzymes producing cytoplasmic NADPH.

The dicarboxylic acid content of the culture broth of shake flask fermentations comparing transformant and control strains are provided in Table 13. As shown in the Table, the transformant strains containing DNA encoding Tes3p$^o$ P's, Cat2p$^{\Delta mts\Delta pts}$ Acc1(S1153A)p and Crc1p (under the control of the G6P1 promoter), generally exhibit higher adipic acid (C6 diacid) production than a control strain that does not contain these transforming nucleic acids.

TABLE 13

Diacid content of culture broth after 48-hour shake flask growth of strains

| Strain | g/L C8 diacid | g/L C6 diacid (yield as % Ymax*) |
|---|---|---|
| sAA5082 | 0.2 | 15.6 (83) |
| sAA6317 | 0.4 | 15.6 (84) |
| sAA6424 | 0.2 | 16.6 (90) |
| sAA6425 | 0.6 | 17.2 (92) |
| sAA6426 | 0.3 | 16.8 (93) |
| sAA6427 | 1.3 | 16.5 (93) |
| sAA6428 | 1.3 | 15.6 (95) |

*Ymax is maximum theoretical yield. It is the amount of product that can be produced for a given biochemical pathway given a certain amount of consumed feedstock (i.e., grams adipic acid/grams oleic acid). The empirical yield is calculated by: mass of product produced divided by the mass of substrate consumed.

Diacid Production by Strains sAA875, sAA6317 and sAA6425 from Oleic Acid in Shake Flasks Transformant strains sAA6317 and sAA6425 were also grown in additional shake flask fermentations of oleic acid (using the same growth and fermentation methods as described in the preceding example for shake flask fermentation and production of diacids by strains sAA6317 and sAA6424-sAA6428) and analyzed for production of fatty acids. Samples of culture broth were taken every 24 hours for gas chromatographic (GC) analysis to determine the diacid composition of the culture broth. The results of analyses of the transformant strains were compared to those of control strain sAA875 (ura3/ura3 pox4a::ura3/pox4b:: ura3 POX5/POX5 faa1:: P$_{URA3}$/faa1/::P$_{URA3}$ fat1-Δ1:: P$_{URA3}$/fat1-Δ2::URA3). Strain sAA875 does not contain genetic modifications for rerouting acetyl-CoA (i.e., DNA encoding the recycling loop enzymes Crc1p, Tes3p$^{\Delta pts}$, Cat2p$^{\Delta mts\Delta pts}$ and Acc1(S1153A)p).

The dicarboxylic acid content of the culture broth of shake flask fermentations comparing transformant and control strains are provided in Table 14. As shown in the Table, the transformant strains containing DNA encoding Tes3p$^{\Delta pts}$, Cat2p$^{\Delta mts\Delta pts}$ Acc1(S1153A)p and Crc1p (under the control of the G6P1 promoter), generally exhibit higher adipic acid (C6 diacid) production than a control strain that does not contain these transforming nucleic acids.

TABLE 14

Diacid content of culture broth after 48-hour shake flask growth of strains

| Strain | g/L C8 diacid | g/L C6 diacid (yield as % Ymax*) |
|---|---|---|
| sAA875 | 6.4 | 8.5 (79) |
| sAA6317 | 0.7 | 18.7 (93) |
| sAA6425 | 1.3 | 17.5 (92) |

*Ymax is maximum theoretical yield. It is the amount of product that can be produced for a given biochemical pathway given a certain amount of consumed feedstock (i.e., grams adipic acid/grams oleic acid). The empirical yield is calculated by: mass of product produced divided by the mass of substrate consumed.

Diacid Production by Strains sAA6317, sAA6425, and sAA6428 from Palm Fatty Acid Distillate (PFAD) in a Fermentor Fermentation medium of composition 0.810 g/L phosphoric acid, 1.22 g/L potassium phosphate dibasic, 1.536 g/L magnesium sulfate heptahydrate, 0.058 g/L calcium sulfate dihydrate, 90 mg/L citric acid anhydrous, 3.0 mg/L biotin, 54 g/L glucose, 1 mL of iron solution (1000× stock solution: 60 g/L iron(II)sulfate heptahydrate, 10% sulfuric acid) and 1 mL trace metals mix (1,000× stock solution: 2.5 g/L citric acid, 0.165 g/L cupric sulfate pehtahydrate, 1.209 g/L manganese sulfate monohydrate, 0.54 g/L sodium molybdate, 1.08 g/L zinc sulfate heptahydrate) was filter sterilized and transferred to a sterile fermentation vessel (New Brunswick Bioflo 310 system using 2.5 L vessels). Growth of all *Candida* strains was initiated with a 5% inoculum (initial OD$_{600\ nm}$=1.0) and growth conditions of 35° C., 1000 rpm, 1 vvm, pH 5.8 and initial volume of 1.0 L. The pH was maintained with a 7% solution of NH$_4$OH. Growth continued for approximately 15 hours before exhaustion of the initial carbon source. When the initial carbon source was exhausted as noted by a marked increase in DO %, the temperature control was changed to 30° C., the pH control was changed to 4.5, and the conversion phase was initiated by turning on a continuous feed of ethylated PFAD at a rate of 1.04 g/L-h. PFAD is a fatty acid-containing residue resulting from the process of refining palm oil. Fermentation conditions were maintained at 30° C., 1000 rpm, 1 vvm, and pH 4.5 for 12 hours at which point the continuous feed rate of ethylated PFAD was changed to 2.25 g/L-h. The fermentation was carried out for a total of 130 hours. Samples were collected for gas chromatographic analysis every 24 hours after initiating the conversion phase.

The dicarboxylic acid content of the final fermentation broth is provided in Table 15. As shown in the Table, the transformant strains sAA6317, sAA6425, and sAA6428 containing DNA encoding Tes3p$^{\Delta pts}$, Cat2p$^{\Delta mts\Delta pts}$, Acc1 (S1153A)p and Crc1p (under the control of the G6P1 promoter), generally exhibit higher adipic acid (C6 diacid) titer and yield than a control strain (sAA5082) that does not contain these transforming nucleic acids.

TABLE 15

Diacid content offermentation broth after 130-hour fermentation of strains

| Strain | g/L C8 diacid | g/L C6 diacid (yield as % Ymax*) |
|---|---|---|
| sAA5082 | 0.9 | 59.0 (81.5) |
| sAA6317 | 2.7 | 60.8 (90.0) |
| sAA6425 | 3.1 | 63.9 (92.4) |
| sAA6428 | 3.9 | 69.3 (96.2) |

*Ymax is maximum theoretical yield. It is the amount of product that can be produced for a given biochemical pathway given a certain amount of consumed feedstock (i.e., grams adipic acid/grams oleic acid). The empirical yield is calculated by: mass of product produced divided by the mass of substrate consumed.

Example 22: Generation of Organisms Expressing Modified ACL1 and ACL2 Genes

Heterolgous nucleic acid constructs containing DNA encoding *Yarrowia lipolytica* CLIB122 ATP citrate lyase subunits (Acl1p and Acl2p) that was codon-optimized for expression in *Candida* strain ATCC 20336 were used to transform yeast host cells. Plasmids pAA1980 and pAA1981 contained the Acl1p and Acl2p subunit-encoding nucleic acids, respectively, operably linked to an HDE1 promoter and PEX11 terminator. The heterologous nucleic acids were used to transform strain sAA886 lacking functional POX4, FAA1 and FAT1 genes.

For transformation of host cells with DNA contained within pAA1980 and pAA1981, the plasmids were digested with BSTZ171 and the linear DNA was introduced into the cells for integration at the ura3 alleles. Transformation reactions were plated on SC-URA to select for transformants that had integrated the DNA cassettes containing the URA3 selectable marker. Individual colonies were restreaked onto YPD plates for isolation prior to further use. Four isolates were verified by PCR to have integrated both pAA1980 and pAA1981 and were saved as strains sAA5244, sAA5245, sAA5246, and sAA5247.

Example 23: Analysis of Organisms in which ATP Citrate Lyase Expression has been Modified Strains transformed with heterologous nucleic acids encoding Acl1p and Acl2p were analyzed for dicarboxylic acid production during growth in shake flasks. Glass flasks (250 mL) containing 25 mL of SP92 media were inoculated with a 5 mL YPD overnight culture to an initial $OD_{600\,nm}$ of 0.2. After 24 h incubation at 30° C. with shaking at 250 rpm (2" throw incubator), the cells were centrifuged and the cell pellet resuspended in 12.5 mL of HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L). The cultures were transferred to fresh 250-mL glass bottom-baffled flasks and 2% v/v oleic acid was added. Cultures were incubated at 30° C. with shaking at 300 rpm to start adipic acid production. Samples of culture broth were taken every 24 hours for gas chromatographic (GC) analysis. Table 16 shows the diacid profile in the culture broth of the shake flasks 48 hours after addition of the oleic acid.

The results of analyses of the transformed strains containing heterologous DNA encoding Acl1p and Acl2p were compared to those of the *Candida* strain sAA875 that was not transformed with the heterologous DNA and does not express an endogenous ATP citrate lyase. As shown in Table 16, the transformants containing heterologous ACL enzyme display an increased titer of adipic acid (C6 diacid) compared to the control strain. Additionally, the transformants selectively produce C6 diacid with very little C8 diacid produced.

TABLE 16

Diacid content of culture broth after 48-hour shake flask growth of strains transformed with DNA encoding ATP citrate lyase

| Strain name | Heterologous ATP-Citrate Lyase | g/L C8 diacid | g/L C6 diacid |
|---|---|---|---|
| sAA875 | None | 3.51 | 7.60 |
| sAA5244 | *Y. lipolytica* ACL1 & ACL2 | 0.01 | 8.76 |
| sAA5245 | *Y. lipolytica* ACL1 & ACL2 | 0.01 | 8.31 |
| sAA5246 | *Y. lipolytica* ACL1 & ACL2 | 0.01 | 8.43 |
| sAA5247 | *Y. lipolytica* ACL1 & ACL2 | 0.01 | 7.87 |

Example 24: Analysis of Organisms in which Thioesterase Expression has been Modified Plasmid pAA1609 harboring the nucleic acid encoding the Tes3p$^{\Delta pts}$ protein under the control of the HDE1 gene promoter and POX4 gene terminator was transformed into strain sAA2800 (ura3/ura3 pox4a::PEX11-P$_{URA3}$/pox4b::PEX11-P$_{URA3}$ faa1::CPRB-P$_{URA3}$/faa1::CPRB-P$_{URA3}$ fat1-Δ1::P$_{URA3}$/fat1-Δ2::P$_{URA3}$ pox5Δ::T$_{URA3}$/poX5Δ::T$_{URA3}$). Two transformants with verified integration of plasmid pAA1609 were compared to the Ura+ parent of strain sAA2800 (strain sAA2748). The control strain (sAA2748) and the two transformants have both alleles of POX4 and POX5 disrupted and are completely beta-oxidation blocked. They are still able to grow on glucose but cannot metabolize fatty acids. Cultures (5 ml) of each strain were grown overnight in YPD medium and used to inoculate 250-mL glass flasks containing 50 mL of SP92 media to an initial OD600 nm of 0.4 (SP92 media: 6.7 g/L Difco yeast nitrogen base, 3.0 g/L Difco yeast extract, 3.0 g/L ammonium sulfate, 1.0 g/L potassium phosphate monobasic, 1.0 g/L potassium phosphate dibasic, 75 g/L glucose). After 24 h incubation at 30° C. with shaking at 250 rpm (2" throw incubator) samples of culture broth were taken for gas chromatographic (GC) analysis to determine the diacid composition of the culture broth.

As shown in Table 17, transformants with the nucleic acid encoding the Tes3p$^{\Delta pts}$ protein localized to the cytoplasm displayed increased concentrations of long chain (C16 and C18) diacids compared to the control strain that does not contain the Tes3p$^{\Delta pts}$-encoding nucleic acid. These long chain diacids may arrive from the activity of the cytoplasmic Tes3p$^{\Delta pts}$ protein converting long chain acyl-CoA products of fatty acid synthesis into free fatty acids. The free fatty acids can then be converted to diacids by the omega oxidation pathway.

TABLE 17

Diacid content of culture broth after 24-hour shake flask growth of strains

| Strain | C16 Diacid (g/L) | C18 Diacid (g/L) | Total long chain Diacid (g/L) |
|---|---|---|---|
| sAA2748 | 0.31 | 0.37 | 0.68 |
| sAA2800 + pAA1609 clone 1 | 0.88 | 1.41 | 2.28 |
| sAA2800 + pAA1609 clone 2 | 0.93 | 1.51 | 2.44 |

Example 25: Amino Acid Sequences Referenced Herein

TABLE 18

| Gene (Organism) | Amino acid sequence | SEQ ID NO |
|---|---|---|
| URA3 (Candida viswanathii ATCC 20336) | MVSTKTYTERASAHPSKVAQRLFRLMESKKTNLCASIDVTTAEFLSLIDKLGPHICLVKTHIDIISDFSYEGTIEPLLVL AERHGFLIFEDRKFADIGNTVMLQYTSGVYRIAAWSDITNAHGVTGKGVVEGLKRGAEGVEKERGVLMLAELSSKGS LAHGEYTRETIEIAKSDREFVIGFIAQRDMGGREEGFDWIIMTPGVGLLDDKGDALGQQYRTVDEVLTGTDVIIVGRG LFGKGRDPEVEGKRYRDAGWKAYLKRTGQLE | 1 |
| CAT2 (Candida viswanathii ATCC 20336) | MFNFKLSQQVLKNSTKSIMPILKKPFSTSHAKGDLFKYQSQLPKLPVPTLEETASKYLKTVEPFLNQEQLESTKAKVA EFVRPGGAGEALQARLNNFAADKDNWLAEFVDDYAYMSYRDPVVPYVSYFFSHKDVKNIIGQDQLLKATLIAYYTIE FQEKVLDESLDPEVIKGNPFCMNAFKYMFNNSRVPAEGSDITQHYNGEENQFFVVIYKNNFYKVPTHKNGQRLTKG EIYSYLQEIKNDATPKGLGLGALTSLNRDEWLSAYNNLLKSPINEASLGSIFASSFVIALDSNNPVTIEEKSKNCWHGD GQNRFFDKPLEFFVSANGNSGFLGEHSRMDATPTVQLNNTIYKQILETNPNDLIVEIGSSAPRFGNAEILPFDINPTTR ANIKDAIAKFDATIAAHDEEIFQHYGYGKGLIKKFKVSPDAYVQLLMQLAYFKYTGKIRPTYESAATRKFLKGRTETGR TVSNESKKFVETWSDPNASSADKVATFQAAAKQHVAYLSAAADGKGVDRHLFGLKQMIQPGEPIPEIFTDPIFSYSQ TWYISSSQVPSEFFQSWGWSQVIDDGFGLAYLINNDWIHVHISCKRGNGLQSDHLKWYLVDSANEMKDVLTKGLLT DAKPKL | 2 |
| CAT2Δms contained in pAA1610 | MPILKKPFSTSHAKGDLFKYQSQLPKLPVPTLEETASKYLKTVEPFLNQEQLESTKAKVAEFVRPGGAGEALQARLN NFAADKDNWLAEFWDDYAYMSYRDPVVPYVSYFFSHKDVKNIIGQDQLLKATLIAYYTIEFQEKVLDESLDPEVIKGN PFCMNAFKYMFNNSRVPAEGSDITQHYNGEENQFFVVIYKNNFYKVPTHKNGQRLTKGEIYSYLQEIKNDATPKGLG LGALTSLNRDEWLSAYNNLLKSPINEASLGSIFASSFVIALDSNNPVTIEEKSKNCWHGDGQNRFFDKPLEFFVSANG NSGFLGEHSRMDATPTVQLNNTIYKQILETNPNDLIVEIGSSAPRFGNAEILPFDINPTTRANIKDAIAKFDATIAAHDEE IFQHYGYGKGLIKKFKVSPDAYVQLLMQLAYFKYTGKIRPTYESAATRKFLKGRTETGRTVSNESKKFVETWSDPNA SSADKVATFQAAAKQHVAYLSAAADGKGVDRHLFGLKQMIQPGEPIPEIFTDPIFSYSQTWYISSSQVPSEFFQSWG WSQVIDDGFGLAYLINNDWIHVHISCKRGNGLQSDHLKWYLVDSANEMKDVLTKGLLTDAKPKL | 3 |
| CAT2Δms,pts contained in pAA1667 | MPILKKPFSTSHAKGDLFKYQSQLPKLPVPTLEETASKYLKTVEPFLNQEQLESTKAKVAEFVRPGGAGEALQARLN NFAADKDNWLAEFWDDYAYMSYRDPVVPYVSYFFSHKDVKNIIGQDQLLKATLIAYYTIEFQEKVLDESLDPEVIKGN PFCMNAFKYMFNNSRVPAEGSDITQHYNGEENQFFVVIYKNNFYKVPTHKNGQRLTKGEIYSYLQEIKNDATPKGLG LGALTSLNRDEWLSAYNNLLKSPINEASLGSIFASSFVIALDSNNPVTIEEKSKNCWHGDGQNRFFDKPLEFFVSANG NSGFLGEHSRMDATPTVQLNNTIYKQILETNPNDLIVEIGSSAPRFGNAEILPFDINPTTRANIKDAIAKFDATIAAHDEE IFQHYGYGKGLIKKFKVSPDAYVQLLMQLAYFKYTGKIRPTYESAATRKFLKGRTETGRTVSNESKKFVETWSDPNA SSADKVATFQAAAKQHVAYLSAAADGKGVDRHLFGLKQMIQPGEPIPEIFTDPIFSYSQTWYISSSQVPSEFFQSWG WSQVIDDGFGLAYLINNDWIHVHISCKRGNGLQSDHLKWYLVDSANEMKDVLTKGLLTDAK | 4 |
| CAT2Δpts contained in pAA1876 | Mfnfklsqqvlknstksimpilkkpfstshakgdlfkyqsqlpklpvptleetaskylktvepflnqeqlestkakvaefvrppgagaealqarlmnfaadkdnwlaefwd dyaymsyrdpvvpyvsyffshkdvkniigqdqllkatlliayytiefqekvldesldpevikgnpfcmnafkymfnnsrvpaegsditqhyngeenqffvviyknnfyk vpthkngqrltkgeiysylqeikndatpkglglgaltslnrdewlsaynnllkspineaslgsifassfvialdsnnpvtieeksknchgdgqnrffdkpleffvsangns gflgehsrmdatpvqlnntiykqiletnpndliveigssaprfgnaeilpfdimpttranikdaiakfdatiaandeeifqhyygygkglikkfkvspdayvqllmqlayfkyt gkiptyessatrfklkgrtetgrtvsneskkfvetwsdpnassadkvatfqaaakqhvaylsaaadgkgvdrhlfglkqmiqpgepipeiftdpifsyqtwyisssqv pseffqswgwsqviddgfglaylinndwihvhiscckrgnglqsdhlkwylvdsanemkdvltkglltdak | 5 |
| YAT1 (Candida viswanathii ATCC 20336) | Mstyyfgetleklpipdlnqtcanylnvlrplqteqehiktavenflkngtgyldaalreyaqtrpsyieqfwydaylnyspvvlnlnpfthedqpftnesssvnpqv kratslvmsslkfiqalknetlsvdtlkggkplcmyqytklfgasripsedgcvmqsdpasnhivvmsksqlywfdvldskmnlilseealnvnfqsiihdslrtpsdeia kssfgvltenrriwanvtnhlmsttmnkvnhevlsiidsalfvlcfddivindlseisknmlcglsildngiqvgtcnrwydklqiivtknakaginfehtgvdghtvlrflnd iytdsilsfansinapslwnttnykeldgedliveprklewltpdlslarlfgetrlsdlinqnefrhlefknygstqlikkmkfspdafvqmafgatyyalygkvectyep amtkfyhgteaiitvsqesnlivrkfidtsvsiqkkleyltqactkhsgqtrmssaggvdrhlyalfcivkrylhdaeddddaskdqpstelsrddtliaqtngdst dddstvvghanhhhnlksadlltkipeifadngwdklnnttistsncgnplrlfgfgpvsangfgiylkddsisicasskhrqtqrflvtlnsyllnlygniwkqaqk meklkaelakavedakpkgqksgeegiiepkpnlstillggyygyfdmgqedikskrgqspeppflhragsgfireigkklrisey | 6 |

TABLE 18-continued

| Gene (Organism) | Amino acid sequence | SEQ ID NO |
|---|---|---|
| COX4 mitochondrial targeting sequence (Candida viswanathii ATCC 20336) | Mlsrttlwarqqtrllstsrilfnsktdq | 7 |
| CIT1 mitochondrial targeting sequence (Candida viswanathii ATCC 20336) | Msalrsfqrssnvakstlknsvrty | 8 |
| CAT2 mitochondrial targeting sequence (Candida viswanathii ATCC 20336) | Mfnfklsqqvlknstksimpilkkpfststhakg | 9 |
| YAT1+COX1mts contained in pAA1967 | Mlsrttlrvargqtrllstsrilfnsktdqstyqfqetleklpipdlnqtcanylnvlrplqteqehiktktavenflkngtgqyldaalreyaqtrpsyieqfwydaylnydspvvlnlmpffilleddpftnesssvnpqvkratslvmsslkfiqalknetlsvdtlkggkplcmyqytklfgasripseedgcvmqsdpasnhivvmsksqlywfdvldsknnlilseaelnvnfqsiihdslrtpsdeiakssfgvlttenrriwanvrhnlmsttnnkvnhevlsiidsalfvlcfddivindlselsknmlcglsildngiqvgtctnrwydklqiivtknakaginfehtgvdghtvlrfvsdiytdsilsfansinsnapslwnttnykeldgedlitvprkleweltpdlslalrfgetrlsdlinqnefrhlefknygstqikkmkfspdafvqmafqatyyalygkvectyepamtkqfyhgrteairtvsqesnlfyrkffdstvsiqkkleyltqactkhsqtrmsaggqvdrhlyalfciwkrylhdaeddddaskdqpsstelsrddthaqtnqgstdddastvvghganhhnlksadllktipeifadngwdklnntiistsncqnpslrlfgfgpvsangfgigyilkddsisicassskhrqtqrflvtlnsylleigniwkqaqkmekikaelakavedakpkgqksgeaegiiepkpnnlstllqqygyfdmqdediksrgqspepfflhragsgfsireigkklrlsey | 10 |
| YAT1+CIT1mts contained in pAA1968 | Msalrsfqrssnvakstlknsvrtystyqfqetleklpipdlnqtcanylnvlrplqteqehiktktavenflkngtgqyldaalreyaqtrpsyieqfwydaylnydspvvlnlmpftlleddpftnesssvnpqvkratslvmsslkfiqalknetlsvdtlkggkplcmyqytklfgasripseedgcvmqsdpasnhivvmsksqlywfdvldsknmlilseaelnvnfqsiihdslrtpsdeiakssfgvlttenrriwanvrhnlmsttnnkvnhevlsiidsalfvlcfddivindlselsknmlcglsildngiqvgtctnrwydklqiivtknakaginfehtgvdghtvlrfvsdiytdsilsfansinsnapslwnttnykeldgedlitvprkleweltpdlslalrfgetrlsdlinqnefrhlefknygstqikkmkfspdafvqmafqatyyalygkvectyepamtkqfyhgrteairtvsqesnlfyrkffdstvsiqkkleyltqactkhsqtrmsaggqvdrhlyalfciwkrylhdaeddddaskdqpsstelsrddthaqtnqgstdddastvvghganhhnlksadllktipeifadngwdklnntiistsncqnpslrlfgfgpvsangfgigyilkddsisicassskhrqtqrflvtlnsylleigniwkqaqkmekikaelakavedakpkgqksgeaegiiepkpnnlstllqqygyfdmqdediksrgqspepfflhragsgfsireigkklrlsey | 11 |
| YAT1+CAT2mts contained in pAA1969 | Mfnfklsqqvlknstksimpilkkpfststhakgstyqfqetleklpipdlnqtcanylnvlrplqteqehiktktavenflkngtgqyldaalreyaqtrpsyieqfwydaylnydspvvlnlmpffilleddpftnesssvnpqvkratslvmsslkfiqalknetlsvdtlkggkplcmyqytklfgasripseedgcvmqsdpasnhivvmsksqlywfdvldsknnlilseaelnvnfqsiihdslrtpsdeiakssfgvlttenrriwanvrhnlmsttnnkvnhevlsiidsalfvlcfddivindlselsknmlcglsildngiqvgtctnrwydklqiivtknakaginfehtgvdghtvlrfvsdiytdsilsfansinsnapslwnttnykeldgedlitvprkleweltpdlslalrfgetrlsdlinqnefrhlefknygstqikkmkfspdafvqmafqatyyalygkvectyepamtkqfyhgrteairtvsqesnlfyrkffdstvsiqkkleyltqactkhsqtrmsaggqvdrhlyalfciwkrylhdaeddddaskdqpsstelsrddtiiaqtnqgstdddastvvghganhhnlksadllktipeifadngwdklnntiistsncqnpslrlfgfgpvsangfgigyilkddsisicassskhrqtqrflvtlnsylleigniwkqaqkmekikaelakavedakpkgqksgeaegiiepkpnnlstllqqygyfdmqdediksrgqspepfflhragsgfsireigkklrlsey | 12 |

TABLE 18-continued

| Gene (Organism) | Amino acid sequence | SEQ ID NO |
|---|---|---|
| YAT1<sup>tps</sup> | Mstyqfqetleklpipdlnqtcanylnvlrplqteqehikttavenflkngtqqyldaalreyaqtrpsyieqfwydaylnydspvvlnlnpfflleddpftnesssvnpqvkratslvmsslkfiqalknetlsvdtlkgqkplcmyqytklfgasripsedgcvmqsdpasnhivvmsksqlyfdvldsknmllseaelnvnfqsiihdslrtpsedlakssfqvlttenrrivanvrhnlmstmnkvmhevlsiidsalfvlcfddivindlselskmlcqlslldngivqvqtctnrwydklqiivtknakaginfehtgvdqhtvlrfvsdiytdsilsfansinsnapslwnttnykeldgedlitvprkleweltpdlslalrfgetrlsdlinqnefrhlefknygstqikkmkfspdafvqmafqatvyalygkvectyepamtkqfyhgrteairtvsqesnlfvrkfdstvsiqkkleyltqactkhsqqtmssaggqvdrhlyalfciwkrylhdaeddddaskdqpsstelsrddtiiaqtngdstdddastttvqghanhhhnlksadlltkiipeifadngwdklinnttistsncgnpslrlfgfgpvsangfgigyilkddsisicasskhrqtqrflvtlnsylleigniwkqaqkmeklkaelakavedakpkgksgeegiiepkpnnlstllggyqyfdmgdedikstgrqgspepfflhrassqfslreiqkklrlseypkl | 13 |
| CRC1 (Candida viswanathii ATCC 20336) | mddvdsaladnykfsaaqgfqqicavltghpfdlvkvrlqtqhpfdlvkvrlqtglyksvqcvketiakdglfglyrgvlpplgvtpmtaysfwgydvgkklvssftgkvdkfeikdistagfisaiptlvaapfervrvmmqieqaksksmqavvaenyrtqqirsifkgtvatlardqpgsalyfateywvkkeltapqedlslfaittaggfaqiamwigvfpidtikstqqssnvkvsivqatknlyakqgikaffpgvgpalarafpanaatflgvelarkfldkvi | 14 |
| ACH1 (Candida viswanathii ATCC 20336) | msailkqrmapylkklrtaeqcvdlfknqgylgwsgftgvgapkavpaalvdhveknklqggmgfhlfvgasaqpeersrwaennmllsrsphqvgkpiaaaindgrtgffddkhlsmfpgdltygfytknkpngsnldytlieataitedgalipgpavgaspemlsvsdniievntkpsfeqihdidlpvnpfrgqpyhttadryigrtaipvdpekviaivettegdkvppntpsdaqsqalaghlieflenevkgqirlpenihplqsqignianavvegvlaqsnfknltvwtevlqdsfldfeesqsldfatatsirliteegfkkfyenwdvyskklclrsqvvsnspeiirrqlqvlaffntpvevdiyahanstnvmgsrnminglqsqsqdflrnaklsvmhtpsarptkvdptqgvscivpmathvdqtehdldvvteqglad1 | 15 |
| ACH1<sup>Δmts-tps</sup> contained in pAA1846 | Mapylkklrtaeqcvdlfknqgylgwsgftgvgapkavpaalvdhveknklqggmgfhlfvgasaqpeesmaennmllsrsphqvgkpiaaaindgrtqffdkhlsmfpgdltygfytknkpngsnldytlieataitedgalipgpavgaspemlsvsdniievntkpsfegihdidlpvnpfrgqpyhttadryigrtaipvdpekviaivettegdkvppntpsdaqsqalaghlieflenevkgqirlpenihplqsqignianavvegvlaqsnfknltvwtevlqdsfldfeesqsldfatatsirliteegfkkfyenwdvyskklclrsqvvsnspeiirrqlqvlaffntpvevdiyahanstnvmgsrnminglqsqsqdflrnaklsvmhtpsarptkvdptqgvscivpmathvdqtehdldvvteqgladlrglspkeraqviinncahpdyqaqlqdyfdravfyatkkkmlhephmlneafamhlnlqengtmklnkgrrak1 | 16 |
| ACC1 contained in pAA245 including 5' intron sequence (Candida viswanathii ATCC 20336) | mrcqvspqrsftnllvhrlprtllnypvvntlfiprrhyslnfsfknllkkmtdlspsptdslnytqlhsslpshflqgnsvltaepsavtdfvkthghtvitkvliannqigavkeirsvrkwayetfgderaiqfvamatpedmeanaeyirmadqfvevpqgtmnnyanvdllveiaertdvhawwqwhasenpllperlaaspkkivflqppqsamrsiqdkiisstivaqhakvpcipwsgtgveevhdpetklvsvdhvyakqcctspedglekakvriqfpvmvksaseqqggkqirkvdhekdfislyngaaneipqspifimklagdarhlevglfadqygtnislfgrdcsvqrrhqkileeapvtiankdtfvemekaavrlgklvgyvsagtveylysyaedkfyflelnprlqvehptemvsqvnlpaaqlqiamqlpmhrirdirllygvdphsateidlefkspnslitqrkpapkgqhctacritsedpgegfkpsggtlhelnfrssnnvgyfsvanqsihsfadsqfghifafgenrqasrkhmivalkelsirqdfrttveylikllletpdfadntittqwldelitkkltaerdpivavvcqavtkahiqaeedkkeyieslekqvpnksllktifpvefiyegerykftatkssedkytlfihgsrcvigarslsdqqlcaldqkshsvywkeeaaatrsvdqktclevendptqlrtpspqklvkylvesqehydagqyaevevmkmcmpliageqngtvqllkqpqstlnaqdilalilaldppskvhakpyeqtipemqdptvtqskpahlfqhydtilknilagydnqvilnstlknmmeilknkelpysewrlqisalhsrippkldealtsliertesrgaefparqiklynktlgpepgneligdvvaplvsianryqnqivehevdyfaslvneycnvehffsgenvreedvilrldenksdlkkvisiciclshsrvsaknnlliaileayepliqgsnsstavairdslkkivglaqsracakvglkarelligclpsikersdqlehilrsavvetsyqevfakhrepkleiqevveskhvvfdvlsgfivhqdcvaiaaqvvrrsvdhvqatagsrynaqaasvgdstmkhaasydslfvvdskssestsrgvlvparhlddveilsaaleyfqpsdaalsfqakgerpellnvlnivitidiqdysdedeciikrihelneyyedlvfaqvyrrvtfvfahqvsyqvpkyytftgpvyeenkvirhiepalafqlegrlanfdikpiftnnrnhhvyealqknapsdkrffirglirggvlkdeislteyliasnrlsdidtlevidtsnsdlnhlifnfsnvfnvqpadveaafasflerfgrrlwrlrvtcgaeirivctdpqggnsfplraiimnvsqyvvksecyylevknpkgdwfksighpqsnhlqpstypypvkesiqpkyrrahmqtfvdfpelfrqatisgwkkhqkkqnkapkdvftslelitdenlvaverdpqankiqmvgficvtaktpeyprgrsfilvanlithkigsfgpdedeyfnkctdlarkiqvtnagsrgnaqasvnqatigvaeliplyqvawneqmpdkgfrylylmpdakealekdqkqtivervedgqethvikaliqaeqqvekimelvsyvpakrqmvpileseedwdridvypkqeafdirwmiiegkvegeefesglfdkapainklgrevysnlqlqqqtqimynqvshltasddlagvekimewlsyvpakrqmvpileseedwdridvypkqeafdirwmiiegkvegeefesglfdkgsfiedlsgwakqvvvgrarigqqipiqvqvettiemmmipadpanpsstealiqeaqqvwypnsafktaqaindfmnqeqlpimilianwrqfsgqgrdmynevlkygsfvdalvdfkqpifyippngelrqqswvvvdptinsdmmenyadvsraqvlepeqmvqikyrrdllatmgrldptyaqlkekindsslspeehaqvstikvrekallpiyaqisvqfadllhqrgmqrrmakqvirkelkwydarrfffwlrrrlneeyvlkiiqeqvknanklekvarllkswmptvdydddqavstwieenhaklqkrveelrqeknksdivkllqedpsnaasvmrdfvdrlsdeekekflksln | 17 |
| ACC1 contained in | mtdlspsptdslnytqlhsslpshflqgnsvltaepsavtdfvkthghtvitkvliannqigavkeirsvrkwayetfgderaiqfvamatpedmeanaeyirmadqfvevpqgtmnnyanvdllveiaertdvhawwqwhasenpllperlaaspkkivflqppqsamrsiqdkiisstivaqhakvpcipwsgtgveevhdpetklvsv | 18 |

TABLE 18-continued

| Gene (Organism) | Amino acid sequence | SEQ ID NO |
|---|---|---|
| pAA1910 (Candida viswanathii ATCC 20336) | ddhvyakgcctspedglekakrigfpvmvkaseggggkgirkvdhekdfislynqaaneipgspifimklagdarhlevglfadqygtnislfgrdcsvqrrhqkiiee apvtiankdtfvemekaavrlgklvgyvsagtveylysyaedktfyfleinprlqvehptemvsgvnlpaaqlqiamglpmhrirdirllygvdphsateidefkspnsl itqrkpapkghctacritsedpgegfkpsggtlhelnfrssnvwgyfsvanqssihfadsqfghifagenqasrkhmivalkelsirgdfrttveyliklletpdfadnt ittgwldelitkkltaerpdpivavvcgavtkahiqaeeedkkeyieslekgqvpnksllktifpvefiyegerykftatcksseedkytiflngsrcvigarslsdgglicaldgks hsvywkeeaaatrlsvdgktcllevendptqlrtpspghlvkylvesgehvdaggsyaevevmkmcmplisqenqqtvqlllkqpgstlhagdilailalddpskvkha kpyegtlpemgdptvtgskpahlfghydtilknilagydnqvilnstiknmmeillkknkelpysevwrlqisalhsrippkldealtsliertesrgaefparqilvnktlgep gnellgdvvaplvslanryqnglveheydyfaslvneycnvehffsgenvreedvildrdenkkdlkkvisiclshsrvsaknnllilaileayepllqnsstavairdslk kivqldsracakvglkarelliqclpsikersdqlehlirsawetsygevfakhrepkleiigeveveskhvvfdvlsqflvhqdcvwalaaaevyvrrsryavdlgkidy hihdrlpievewktklaqiagsrynavqsasvgddsttmkhaaaysdlsfvvdsksestsrtgvlvparhlddveilsaaleyfqpsdalsfqakgerpellnvlnvitdi dgysdedeclkriheilneyeddlvfagyrrvtfvfahqvgsypkyyttgpvveenkvirhiepalafqleigrlanfdikpifitnmnihvyaeaiqknapsdkrftrgiirg gvlkdeisleyliaesmrlisdildtlevidtsnsdlnhifinfsnvfnvqpadveaafasfrlerfgrrlwrlrvtgaeirivctdpqgnsfplraiinnvsgyvkselyievknp kgdwfksighpgsmhlqppistypyvkeslqpkryrahnmgttfvydfpelfrqatisqwkkhgkkapkdvftslelitcdendalvavervdpgankigmvgflcvtakt peyprgrsfiivandiithkigsfgpdedeyfnkctdlarklgvprilyansgagrigvaeeliplyqvawneegnpdkgfrylylnpdakealekdgkqdtiverivedq qerhvikaaliqaenqglveclkggsgliagatsrayrdifitiltiivtcrsvgigaylvrlqgraiqiegqpiillqgapainkllqrevysnlqgqgtqimynngvshltaasddlagv ekimewlsyyakrgmpvplesedtwdraidyyrppkqeaafdirwmiegkqvegeefesglfdkgsfqetlsgvwakgvvvqrarlqgipigivetriienmipad panpsstealiqeaqqvwypnsafktaqainfnmgeqlplmilanwrfgsggqrdmynevlkygsggqrdmynevlkyssfivdalvdfkqpiftyippngelrggsvvvvdptinsdmm emyadvdsragvlepegmvgikyrrdkllatmqrldptyaqlkeklndslspeehaqvstkivrekallpiyaqisvqfadlhdrsgrmmakgvirkeikwdarr fffwrlrrrineeyvlkligeqvknankleakvarlkswmptvdyddqaqvstwieenhaklqkrveelrqekenksdivkllqedpsnaasvmrdfvdrlsdeekefl sln | 19 |
| ACC1 contained in pAA1907 (S1153A) | mtdlspsptdslnytqlhsslpshflggnsvltaepsavtdfvkthqghtvitkvlianngigavkeirsvrkwayetfgderaiqfvamatpedmeanaeyirmadqf vevpggtmnnyanvdliveiaertdvhavwagwghasenplliperlaaspkkivfigppgsamrslgdkisstivaqhakvpcipwsgtgveevhvdpetklvsv ddhvyakgcctspedglekakrigfpvmvkaseggggkgirkvdhekdfislynqaaneipgspifimklagdarhlevglfadqygtnislfgrdcsvqrrhqkiiee apvtiankdtfvemekaavrlgklvgyvsagtveylysyaedktfyfleinprlqvehptemvsgvnlpaaqlqiamglpmhrirdirllygvdphsateidefkspnsl itqrkpapkghctacritsedpgegfkpsggtlhelnfrssnvwgyfsvanqssihfadsqfghifagenqasrkhmivalkelsirgdfrttveyliklletpdfadnt ittgwldelitkkltaerpdpivavvcgavtkahiqaeeedkkeyieslekgqvpnksllktifpvefiyegerykftatcksseedkytiflngsrcvigarslsdgglicaldgks hsvywkeeaaatrlsvdgktcllevendptqlrtpspghlvkylvesgehvdaggsyaevevmkmcmplisqenqqtvqlllkqpgstlhagdilailalddpskvkha kpyegtlpemgdptvtgskpahlfghydtilknilagydnqvilnstiknmmeillkknkelpysevwrlqisalhsrippkldealtsliertesrgaefparqilvnktlgep gnellgdvvaplvslanryqnglveheydyfaslvneycnvehffsgenvreedvildrdenkkdlkkvisiclshsrvsaknnllilaileayepllqnsstavairdslk kivqldsracakvglkarelliqclpsikersdqlehlirsawetsygevfakhrepkleiigeveveskhvvfdvlsqflvhqdcvwalaaaevyvrrsryavdlgkidy hihdrlpievewktklaqiagsrynavqsasvgddsttmkhaaaysdlsfvvdsksestsrtgvlvparhlddveilsaaleyfqpsdalsfqakgerpellnvlnvitdi dgysdedeclkriheilneyeddlvfagyrrvtfvfahqvgsypkyyttgpvveenkvirhiepalafqleigrlanfdikpifitnmnihvyaeaiqknapsdkrftrgiirg gvlkdeisleyliaesmrlisdildtlevidtsnsdlnhifinfsnvfnvqpadveaafasfrlerfgrrlwrlrvtgaeirivctdpqgnsfplraiinnvsgyvkselyievknp kgdwfksighpgsmhlqppistypyvkeslqpkryrahnmgttfvydfpelfrqatisqwkkhgkkapkdvftslelitcdendalvavervdpgankigmvgflcvtakt peyprgrsfiivandiithkigsfgpdedeyfnkctdlarklgvprilyansgagrigvaeeliplyqvawneegnpdkgfrylylnpdakealekdgkqdtiverivedq qerhvikaaliqaenqglveclkggsgliagatsrayrdifitiltiivtcrsvgigaylvrlqgraiqiegqpiillqgapainkllqrevysnlqgqgtqimynngvshltaasddlagv ekimewlsyyakrgmpvplesedtwdraidyyrppkqeaafdirwmiegkqvegeefesglfdkgsfqetlsgvwakgvvvqrarlqgipigivetriienmipad panpsstealiqeaqqvwypnsafktaqainfnmgeqlplmilanwrfgsggqrdmynevlkygsggqrdmynevlkyssfivdalvdfkqpiftyippngelrggsvvvvdptinsdmm emyadvdsragvlepegmvgikyrrdkllatmqrldptyaqlkeklndslspeehaqvstkivrekallpiyaqisvqfadlhdrsgrmmakgvirkeikwdarr fffwrlrrrineeyvlkligeqvknankleakvarlkswmptvdyddqaqvstwieenhaklqkrveelrqekenksdivkllqedpsnaasvmrdfvdrlsdeekefl sln |  |
| ACS1 (Candida viswanathii ATCC 20336) | Mpestgqshisldhekmqgpptgftesrtakpnladftdtykklykqsvenpneffteqanknldwfkpfdlaffpvdpkddfkngdlpawfingglnasynavdrw aikmpdkpailyedgepdsgriityggelikevsklaqtitklgvkkgdsvavyipmipealvtllaivrigavhsvvfagfssaslrdriladsrivtladesrggktietkki vddalkecpkvrnvlvfkrtgnshvfppvsagrdlwheemakygpfppvvmsedlfllytsggstgkpkgvqhtagylagalltkytfdvheedvlftagdvgwitg htycvgpllcgattvvfegtpaypnysryweivdqykvnqfyvaptalrllkragtkyvekydlsslrvlgsvgepiaaevwhywndnigrgkahivdtywqtesgsh lltplagvptkpgsaslpffgvvpkildptgeelegndvegvlaiksawpsitrgiyndnyrfietylapyhdhyfsgdgaardndgfyvilgrvdvvnvsghristaei eaaliehpvaesavvgyaddltgvaavyyslkdrvgddmeavkkeliltvrkeigpfaapklillvddilpktrsgkimrrlkvlageedqlqdistisnpgvvqqii eivhackk | 20 |

TABLE 18-continued

| Gene (Organism) | Amino acid sequence | SEQ ID NO |
|---|---|---|
| ACS2 (Candida viswanathii ATCC 20336) | Mtdsnthkvvheangvklrqtpkeffqrqpnktghiqdteeykklyeqsikdpogffgplakellswdsdfhtvksgtlkngdaawflggklnasyncvarhalanpn kpaiiyeadeerdsyiltygdlirevskvagvlhswgirkgdtvavylpmnaqaliamlaiarlgaahsvifagfsssgsikdryndasckalitcdegrrggrttnlklcd ealkgcptvkhvlvhrrtgnpeikltegrdyywdeetakfsgyfppvpvdsedplfllytsgstpkgvvhtagyllgaalstkyifdvhpedvfftagdvgwitgthtyal ygpllgvpsvvfegtpaypdygrgrfwgivekhkathfyvaptalrllrrkageqegvgkydlsslrtlgsvgepidiwewynefvgkdqchisdytwqtesgshliapla gaiankpgsasypffgieaalidpvtgveikqhnqdvegvlvvkdhwpsmartvfnnhvkymdtymnpypgyyftgdgaardndgyywirgrvddvvnvsghrlst aeiesaliedprvgesavvgindditqgaviayvalksgdvadedalrkelilvrkeigpfaapksvilvqdlpktrsgkimrrilkvssneadqigdittlqmpgsveg misafgaqfgrk | 21 |
| TES1-1 (Candida viswanathii ATCC 20336) | Mltltsgpnplpdfeealrvikvddthyvgahslrlpvkggrgvvgghmiaqsllvgiestrdktnkvfipdsyhsyfigagnakipmnytveklyddenvskrfiiaeq kgrhrlctvtlrrpgtkpfhdsnldisipvphiqlkhpdpdklhqvghtdfirnafgkelmdyrecpeenelyaaerwltvftgirnqpkpgasletvveelpdaggqm htveksilrpkdsqsfikdpiynfvgladisdsaflttmarilhipwapsieiddtydpardatyimrstlnaahifhynamsldhhiyfhmedytsdqsgfdickdwlaft yqmkrlsnnrtlvrgflfnekhkciatvvqegltimqngvgrtadksrl | 22 |
| TES2-1 (Candida viswanathii ATCC 20336) | Mienisgngryqnhevdlekefgvekiginlyrgkspipkpdrrsrgayggylaggallvamkstppeyrphsfsyfikavndketlewrveetsngrnyanrslq afgagnlvytanvsltkknsakkaeeatgvkpfefqgkpnhewfekhkrddlplatpssslliyhkffpevvsleaskeeesskpaadrelswyfkwgineeeghqpl vmlnsdyqyvgmaaltdavylnrllrilrvedadhtqlvhyfsysldhtmyfhdddfdvtkwmgftfkvtrfshnralcqgevyndkgvhvctivqeglmmlnglegga kl | 23 |
| TES2-2 (Candida viswanathii ATCC 20336) | Mieesisengnypqnhevdlekefgvekiginlyrgkspipkpdrrsrgayggylaggallvamkstppeyrphsfsyfikavndkvtlewrveetsngrmyanralq afgagdlvytanvsltkknsakkteeatgvkpfefqgkphewfdkhkiddlplatpssslliyhkffpevvsleaskeeeskpaadrelswyfkwginneeghqplv nlnsdyqyvgmaaltdavylnrllrilrvqdadhtqlvhyfsysldhtmyfhdddfdvtkwmgftfkvtrfshnralcqgevyndkgvhvctivqeglmmlnleegakl | 24 |
| TES3-1 (Candida viswanathii ATCC 20336) | Mshptpeevygvtkvaenkyvgnrpinkptgrtgvygnfcaqallvaiesapegftphsihsenfirggdpevpvewevevisngkfanrivkgvqhgivvyvat vsltnknstrrnesftydtpdetvktygnaeldtyyqgwlyleymyypkqlhshgisvykwgpendawkdasqtyqfvglaaisdvldlgqlirnlidhlstpkfnvsl dhsvyfhgaddfdvtrwsttirmtklahgraliegemysdgrhiasivgerlyiaesppkl | 25 |
| TES4-1 (Candida viswanathii ATCC 20336) | Mtsiapatdipavdistiyvkqidanryrgvrplkgarefgvfggnlvaqsvvvalrsvpagfhpnsvhayyvravtdetpiewevettgrtfanrsirglqnkkv vftasislktknsnaevigktghpslqfqrdtepyyeqmrarpgeckvlyinanthltvrqfpevssrdvfslvrfgndgrerivgmtpeyqyaalasdwvrlrfyfdn mgvdvqtsfdvsldhsiyfhddgfdateylvfsvkvsrishsrvlydggifndrgahvasirgerlyvvsnkpkf | 26 |
| TES5-1 (Candida viswanathii ATCC 20336) | Mptfnykdgetidvqkefgvvetapnkyvgvkplvkpmphvkgvfggnlaggalllvamksvgpdfsphslhsyfiragsdqtpvewtvgaisdqnsfcnrfikgvq ngqviyianvsltkrnsaadamkyeeyhaqirqkgkdgdadeededddednapakpfgfqtpshkwikdrdldkipvsdmesnlllykippefvslksste eeslpvserrmgalakwgieneqgfnqpltnldksfqyvglanitdglylgtlnrliriddltlderatnyfsyslldhviyfhdddfdvtkwmgftfrcsryshntvifegeiys dkgvqvasiiqeglvrfkdgylknakl | 27 |
| TES6-1 (Candida viswanathii ATCC 20336) | Msttgiynakpaaailettktkvklvytegpklvyeglhpvetiketvrgtyggdfiaggymvaawesignmdfqphslhayyikasgqesvlrwevfkvsdsrsfanr mltayqthtnqlvftmqifsflqsfldsgvwfcftralglplgsyekefrvsldhtvyfhdanfdssewifldfrfvmmknnrfltvlnyytlqgkliatvlqevytslhqgiidksgelavk sgnkkqvttpkl | 28 |
| TES7-1 (Candida viswanathii ATCC 20336) | Mdklqaevyeaeppvakleaktaaklisadgakltyegvypvelvrkglrgtyggdfiagginvawesignktdfqphslhayfvkagsdssvlrwevlkvsdrnfa nrlmlayqthtnqlvftmqisftkdnneelkraeykqllqsggkirsipfaikppnekyfklkdkvddlpyfehtngmataippdfleyatemhdtvgnhkefgifmk vlddyslgknyerqflglafldavwlsfftpalgltlqterkffrvsldhtmyfhdanfdssewifvdfrfvnlmnrrilgvvmfytlqgklvatviqeaymflhqaiidksq eiaeksghkkqvitpkl | 29 |
| TES7-2 (Candida | Mdklqaevydaeppvakleaktaaklisadgakliyegvypveelvrkglrgtyggdfiagginvawesignktdfqphslhayfvkagsdqsvlrwevlkvsdrsfa nrlmlayqthtnqlvftmqisftkdnneelkraeykqllesggkirsipfaikppnekyfklkdkvddlpyfehtngmataippdfleyatemhdtvgmflhqaiidksq | 30 |

TABLE 18-continued

| Gene (Organism) | Amino acid sequence | SEQ ID NO |
|---|---|---|
| viswanathii ATCC 20336 | vlddyslkdnyerqsflglaflsdavwlssftpalglpigtferkffrvsldhtmyfhdanfdssewifvdffvnlnnnrllgvvnfytlqgklvatviqeaymflhqgiidqsq eiaeksqhkkqvitpkl | 31 |
| TES8-1 (Candida viswanathii ATCC 20336) | Merlqaevydakptvakletktvklvaqdgkrlvyeaiypvehikegipgayggdtlaqgmaawdslgdkkdfqphsvhsyfvkpatnksilmevikvsdgrsf anrfvsgyqthnnalvftmgistfktyndevvkiaeynkllesggkirsipfvikkapnekyfkfdnigdlryiehtngniatamsedlfeyatemhdtlgnqefgifmk vldnyslgsdytkqsylglaflsdaiwmsvcsralglpfgsyhrqffgvsmdhsmyfhdanfdstewifldffvmlkndrllqvanfytleqklistliqeaylfhpgiiaks qeiavksgnkrqvkmpkl | 32 |
| TES3-1Δpts Contained in pAA1609 | Mshptpeevygvgvtvaenkyvgnvrplnkptpktrgvyggnfcaqailvaiesapegftphsihsnfiirggdpevpwevevisngksfanrivkgvghgivvvat vsltnknstrnesftydtppdetvktygnaeldtyvgwlylevknypkqlhshqisyvkwgpendawkdasqtyqfvglaaisdvldigqilrnldihlstpkfnvsl dhsvyfhgadfdvtrwstttirmtklahgraliegemysdqgrhiasivqerlyiaes | 33 |
| PEX11 (Candida viswanathii ATCC 20336) | mvadslvhptvsklvkfldttpkrekvfrllsylsrflgyyayrkgysketiafanlkgnftfirkamrflkpinhlqlaskaydnklldpvlqittiirnlayagyltidqviffkllgl idakkfpnlatyasrfwlliqliaglinsliriiyelkdyehqegdkeketdakaihtkiyaakrklvwdlldtfialnsldilhftegdvgfagtitslligledlwkat | 34 |
| CPRB (Candida viswanathii ATCC 20336) | MALDKLDLVIITLVVAVAAYFAKNQFLDQPQDTGFLNTDSGSNSRDVLSTLKKNNKNTLLLFGSQTGTAEDYANKLS RELHSRFGLKTMVADFADYDMDNFGDITEDILVFFIVATYGEGEPTDNADEFHTWLTEEADTLSRYTVFGLGNSTY EFFNAIGRKFPDRLLSEKGGDRFAEYAEGDDGTGTLDEDFMAWKDNVFDALKNDLNFEEKELKYEPNVKLTERDDLS AADSQVSLGEPNKKYINSEGIDLTKGPFDHTHPYLARITETRELFSSKERHCIHVEFDISESNLKYTTGDHLAIWPSNS DENIKQFAKCFGLEDKLDTVIELKALDSTYTIPPPTPITYGAVIRHHLEISGPVSRQFFLSIAGFAPDEETKKTFTRLGGD KQEFATKVTRRKFNIADALLYSSNNTPWSDVPFEFLIENIQHLTPRYYSISSSSLSEKQLINVTAVVEAEEEADGRPVT GVVINLLKNIEIAQNKTGEKPLVHDLSGPRGKFNKFKLPVHVRRSNFKLPKNSTTPVLIGPGTGVAPLRGFVRERV QQVKNGVNGKTLLFYGCRNSNEDFLYKQEMAEYASVLGENFEMFNAFSRQDPSKKVVYQDKILENSQLVHELLTE GAIIYVCGDASRMARDVQTTISKIVAKSREISEDCKAAELVKSWKVQNRYQEDVN | 35 |
| FAA1 (Candida viswanathii ATCC 20336) | MGAPLTVAVGEAKPGETAPRRKAAQKMASVERPTDSKATTLPDFIEECFARNGTRDAMAWRDLVEIHVETKQVTKII DGEQKKVDKDMIYYEMGPYNYISYPKLLTIVKNYSKGLLELGLAPDQESKLMIFASTSHKWMQTPLASSFQGIPVVT AYDTLGESGLTHSLVQTESDAVFTDNQLLSSLIRPLEKATSVKYVIHGEKIDPNDKRQGGKIYQDAEKAKEKILQIRPDI KFISPDEVVALGEQSSKELHFPKPEDPICIMYTSGSTGAPKGVVITNANIVAAVGGISTNATRDLVRTVDRVIAFLPLAHI FELAPELVTFWWGAPLGYANVKTLTEASCRNCQPDLIEFKPTIMVGVAAVWESVRKGVLSKLKQASPIQQKIFWAAF NAKSTLNRYGLPGGGLFDAVFKKVKAATGGQLRYVLNGGSPISVDAQVFISTLLAPMLLGYGLTETCANTTIVEHTRF QIGTLGTLVGSVTAKLVDVADAGYYAKNNOGEIWLKGGPVVKEYYKNEEETKAAFTEDGWFKTGDIGEWTADGGLN IIDRKKNLVKTLNGEYIALEKLESIYRSNHLILNLCVYADQTKVKPIATVLPIEANLKSMLKDEKIIPDADSQELSSLVHNKK VAQAVIRHLLQTGKQQGLKGIELLQNVVLLDDEWTPQNGFVTSAQKLQRKKILESSCKKEVEEAYKSS | 36 |
| POX5 (Candida viswanathii ATCC 20336) | MPTELQKERELTKFNPKELNYFLEGSQERSEIISNMVEQMQKDPILKVDASYNLTKDQQREVTAKKIARLSRYPEHE YPDQQAQRLSILGVFDPQVFTRIGVNLGLFVSCVRGNGTNSQFFYWTINKGIDKLRGIYGCFGMTELAHGSNVQGIE TTATFDEDTDEFVINTPHIGATKWNIGGAAHSATHCSVYARLKVKGKDYGVKTFVVPLRDSNHDLEPGVTVGDIGAK MGRDGIDNGNIQPFSNVRIPRFFMLQKYCKVSRLGEVTMPPSEQLSYSALIGGRVTMMDSYRMTSRFITIALRYAIH RRQFKKKDTDTIETKLIDYPLHQKKLFPFLAAAYLFSQGALYLEQTMNATNDKLDEAVSAGEKEAIDAAIVESKKLFVA SGCLKSTCWLTAREAIDEARQACCGHGYSSYNGRFGKAYSDWVQCTWEGDNNILAMNVAKPMVRDLLKEPEQKG LVLSSVADLDDPAKLVKAFDHALSGLARDIGAVAEBDKGFDITGPSLVLVSKLNAHRFLIDGFFKRITPEWSEVLRPLGF LYADWILTNFGATFLQYGIITPDVSRKISSEHFPALCAKVRPNVVGLTDGFNLTDMMTNAAIGRYDGNVYEHYPETVK ALNPPENTRAPYSKALEDMLNRPDLEVRERGEKSEEAAEILSS | 36 |
| POX5 (F98G) (Candida viswanathii | MPTELQKERELTKFNPKELNYFLEGSQERSEIISNMVEQMQKDPILKVDASYNLTKDQQREVTAKKIARLSRYPEHE YPDQQAQRLSILGVFDPQVGTRIGVNLGLFVSCVRGNGTNSQFFYWTINKGIDKLRGIYGCFGMTELAHGSNVQGIE TTATFDEDTDEFVINTPHIGATKWNIGGAAHSATHCSVYARLKVKGKDYGVKTFVVPLRDSNHDLEPGVTVGDIGAK | 37 |

TABLE 18-continued

| Gene (Organism) | Amino acid sequence | SEQ ID NO |
|---|---|---|
| ATCC 20336 mutant) | MGRDGIDNGWIQFSNVRIPRFFMLQKYCKVSRLGEVTMPPSEQLSYSALLIGGRVTMMDSYRMTSRFITIALRYAIH RRQFKKKDTDTIETKLIDYPLHQKRLFPFLAAAYLFSQGALYLEQTMNATNDKLDEAVSAGEKEAIDAAIVESKKLFVA SGCLKSTCTWLTAEAIDEARQACGHGYSSYNGFGKAYSDFVVQCTWEGDNNILAMNVAKPMVRDLLKEPEQKGL VLSSVADLLDDPAKLVKAFDHALSGLARDIGAVAEDKGFDITGPSLVLVSKLNAHRFLIDGFFKRITPEWSEVLRPLGFL YADWILTNFGATFLQYGIITPDVSRKISSEHFPALCAKVRPNVVGLTDGFNLTDMMTNAAIGRYDGNVYEHYFETVKA LNPPENTKAPYSKALEDMLNRPDLEVRERGEKSEEAAEILSS | 38 |
| POX5(W429F) (Candida viswanathii ATCC 20336 mutant) | MPTELQKERELTKFNPKELNYFLEGSQERSEIISNMVEQMQKDPILKVDASYNLTKDQQREVTAKKIARLSRYPEHE YPDQQAQRLSILGVFDPQVFTRIGVNLGLFVSCVRGNGTNSQFFYWTINKGIDKLRGIYGCFGMTELAHGSNVQGIE TTATFDEDTDEFVINTPHIGATKWWIGGAAHSATHCSVYARLKVKGKDYGVKTFVVPLRDSNHDLEPGVTVGDIGAK MGRDGIDNGWIQFSNVRIPRFFMLQKYCKVSRLGEVTMPPSEQLSYSALLIGGRVTMMDSYRMTSRFITIALRYAIH RRQFKKKDTDTIETKLIDYPLHQKRLFPFLAAAYLFSQGALYLEQTMNATNDKLDEAVSAGEKEAIDAAIVESKKLFVA SGCLKSTCTWLTAEAIDEARQACGHGYSSYNGFGKAYSDWVVQCTWEGDNNILAMNVAKPMVRDLLKEPEQKG LVLSSVADLLDDPAKLVKAFDHALSGLARDIGAVAEDKGPDITGPSLVLVSKLNAHRFLIDGFFKRITPEWSEVLRPLGF LYADWILTNFGATFLQYGIITPDVSRKISSEHFPALCAKVRPNVVGLTDGFNLTDMMTNAAIGRYDNVYEHYFETVK ALNPPENTKAPYSKALEDMLNRPDLEVRERGEKSEEAAEILSS | |
| POX4 (Candida viswanathii ATCC 20336) | MTFFKKNVSVSQGPDPRSSIQKERDSSKVVNPQQMNYFLEGSVERSELMKALAQQMERDPILFTDGSYDLTKDQQ RELTAVKINRIARYREQESIDTFNKRLSLIGIFDPQVGTRIGVNLGLFLSCIRGNGTTSQLNYWANEKETADVKGIYGCF GMTELAHGSNVAGLETTATFDKESDEFVINTPHIGATKWWIGGAAHSATHCSVYARLIVDGQDYGVKTFVVPLRDSN HDLMPGVTVGDIGAKMGRDGIDNGWIQFSNVRIPRFFMLQKFCKVSAEGEVTLPLEQLSYSALLGGRVMMVLDSY RMLARMSTIALRYAIGRRQFKGDNVDPKDPNALETQLIDYPLHQKRLFPYLAAAYVISAGALKVEDTIHNTLAELDAAV EKNDTKAIFKSIDDMKSLFVDSGSLKSTATVVLGAEAIDQCRQACGGHGYSSYNGFGKAYNDMVVQCTWEGDNNVL AMSVGKPIVKQVISIEDAGKTVRGSTAFLNLQKDYTGSNSSKVVLNTVADLLDDIKTVIKAIEVAIIRLSQEEAASIVKKRSF DYVGAELVQLSKLKAHHYLITEYIRRIDTDTFDQKDLIVPYLITLGKLYAATIVLDRPAGVFLTFNVASTEAITALASVQIPKL CAEVRPNVVAYTDSFQQSDMIVNSAIGRYDGDIYENYFDLVKLQNPPSKTKAPYSDALEAMLNRPTLDRERFEKSD ETAAILSK | 39 |
| PXA1 (Candida viswanathii ATCC 20336) | Mvniskltgynkqdirmvvllqefvktykdnkiklnyssrpvlifistlvatagigvffflrsivtkyneylinkrirrpsfirqsnilkngsrettqkgngkvtriilipktamndqya adkylykdfarneqilqqqkgrlfnsainqltiiwkilipkfycqntslllsqcffliifrtwlslliaklldgivknliaadgrkfardliyflliafpasytnaaiykylelrlalgfrtnltryih dmyldktmsyykvgingadignidqyitedvtkfcmslcslfssmgkpfidliffsvylrdnigtgafigifanyfataimlkatprfgklaakrthlegvyfngqlnimtns eeigfykgskieksklaenfdklmghvsreinlsssyaaledyvllkytwsawgyifsglpvfladylfpkedpssghiadiddddahghghtgeetssttenmktfvtn krllisladagsrlmvslkevttlgitnrvfmrtligithvrhdpkfdygdkygldrlrhvtptpaegsystplipdltfdikgknllfvgpngsgktsvarvl aglwplyaglvskpsdlfnpqksyffigslrdqvvypnrsenttndqifhilhcvhldhivkryglnqnldfaktisggekqrlsfarvlfnrpsivildsstsalspdmeelm yqvlqdhkinyvtlsnrpslskfhdkvfei | 40 |
| PXA2 (Candida viswanathii ATCC 20336) | Mtvenaklqtnslaysllkvyksnrslllntsyilliliaaftgatnrgrgtsssrssakvetdeeqsvkkhpklsresfhrlkrailpffdrtivyffanitlivralltlrvatldgqlv galvsrrirvfakyllywmllgipaaltnallnwtksnlseksirmnlnnmimeeylpdnldpnyyslihltdnkirdpnqrittdtsrlsdalaslpghilkptldiilcaqqlsksg vgngegtlalgilahfstmiirffsppfaklaaeranleeglrsahskivanseeiafligghdreldhidhcytlefskgeywkraiheitcgtfivkyfwgvagilvcsapvf iakylgepedknvagnfitnrrllmsasdsidrilysrrylqvvqhatrvsdfidtlheveekkritsnvqfmndeitfdhvrlmtptevtlipdlnfsikpgdhllivgpmpngsg ksslfrmlgqlwpvrfgtiripntenmfylpqkavlvegsfreqiiyphnvtqqkktdqqlkeilkvllkledysgqldevkkwseelsigaqqrlamarlyyhepkfavlde ctsavspdmeqlmyqhagqlgitllsvahrpalwifhkylilefdgkgsyyfgtldekhkmkleeerlkkeneksvakk | 41 |
| ACL1 (Yarrowia lipolytica CLIB122) | msaneisrfdapvgkehpayelfmhtrsfvyglqppracggmldfdfickrenpsvagvlypfgggfvtkmywgtketlpvyqqvekaaakhpevdvvmfass rsvysstmelleypgfrtlalaaegyperrareilhkaqdkgvtfigpatvgglkpgdkvgntsgmmdnivasklyrpgsvayysksggmsnelnniiishtdgvyegi aiggdarypgtfidhilryeadpkckfivllgevygeveyrrieavknggikkpivawaigtcasmfktevqfghagsmansdletakaknaamksagfyvpdfed mpevlaelyekmvakgelsrisepevpkipidyswagelgllirkpaafistisddrgeellyagmpiesevfkedigigvmsllwfrrlpdyaskflemvlmltadhgp avsgamntfittragkdlisslvagllitgtrfggaldgaatefttaydkglsprqfvdtmrkqnklipgighrvksrmpdfrvelvdkfviknfpstqlldyalaveevttskk dnllinvdgaiaysfvdlmrscgaftveetedylkngvlnglfvlgrsigliahhldqkrlktglyrhpwddityvlggeaiqkkrvelsagdvskaktrs | 42 |

TABLE 18-continued

| Gene (Organism) | Amino acid sequence | SEQ ID NO |
|---|---|---|
| ACL2 (Yarrowia lipolytica CLIB122) | Msaksiheadgkallahflskapywaeqqpintfemgtpklasltfedgvapeqifaaaektypwllesgakfvakpdqfikrrgkagllvlnksweeckpwiaeraa kpinvegidgvlrtflvepfvphdqkheyyinihsvreqdwilffyheggvdvgdvdataakilipvdieneypsnatitkellahvpedqhqtlldfimrlyavyvdlqftyl einplwiptaggvevhyldlagkldqtaefecgpkwaaarspaalgqvvtidagstkvsidagpamvfpapfgrelskeeayiaeldsktgaslkltvlnakgriwtly agggasvvyadaiasagfadelanygeysgapnetqtyeyaktvldlmtrgdahpegkvlfigggianftqvgstfkgiirafrdyqsslhnhkvkiyvrrgspnwqe glrliksagdelnlpmeiygpdmhvsgivplaligkrpknvkpfgtgpsteastplgv | 43 |
| FAT1 (Candida viswanathii ATCC 20336) | MSGLEIAAAAILGSQLLEAKYLIADDVSLAKTVAVNALPYLWKASRGKASYWYFFEQSVFKNPNNKALAFPRPRKNAP TPKTDAEGFQIYDDQFDLEEYTYKELYDMVLKYSYILKNEYGVTANDTIGVSCMNKPLFVLWLALWNIGALPAFLNFN TKDKPLIHCLKIVNASQVFVDPDCDSPIRDTEAQIREELPHVQINYIDERALFDRLRLKSTPKHRAEDKTRRPTDTDSS ACALIYTSGTTGLPKAGIMSVVRKAFMASVFFGHIMKIDSKSNVLTAMPLYHSTAAMLGLCPTLIVGGCVSVSQKFSAT SFWTQARLCCATHVQYVGEVCRYLLNSKPHPDQDRHNVRIAYGNGLRPDIWSEFKRRFHIEGIGEFYAATESPIATT NLQYGEYGVGACRKYGSLISLLSTQQKLAKMDPBDESEIYKDPKTGFCTEAAYNEPGELLMRILNPNLDVQKSFQGY YGNKSATNSKILTNVFKKGDAWYRSGDLLKMDEDKLLYFVDRLGDTFRWKSENVSATEVENELMGSKALKQSVVVG VKVPNHEGRACFAVCEAKDELSHEEILKLIHSHVTKSLPVYAQPAFIKIGTIEASHNHKVPKNQFKNQKLPKGEDGKDL IYWLNGDKIYQELTEDDWSLICTGKAKL | 44 |
| CYP52A17 (Candida viswanathii ATCC 20336) FROM pAA1712 | Mieqlleywvvpvlyliikqllaytktrvlmkklgaapvtnklydnafgivngwkalqfickegraqeyndykfdhsknpsvgtyvsilfgtrivvtkdpenikailatqfgd fslgkrhtlfkpligdgifidgegwkhsramlrpqfareqvahvtslephfqllkkhilkhgeyfdiqelfirftvdsatefilfgesvhslkdesiginqdidfagrkdfaesf nkaqeylairtlvqtfywlvnnkefrdctksvhkftnyyvqkaldaspeeleksqsgyvflyelvkqtrdpnvirdqslniilagrdtaglisfavfelarhpeiwaklreeieq qfglgedsrveeitfeslkrceylkaflnetlriypsvprnfriatkntlprgggsdgtspliliqkgeaysyginsthldpvyygpdaaefrperwfepstklgwaylpfng gprlclgqqfaalteagvlvrlvqefshvrsdpdevyppkrltnltmclqdgaivkfd | 45 |
| ADH1-2 alcohol dehydrogenase (Candida viswanathii ATCC 20336) | MHALFSKSVFLKYVSSPTTSAIPHSLEFIVSRSSYLRRIPPYLPRCSHFPSFYYSSSSVYTKKSFHTMSANIPKTQKA VVFEKNGGELKYKDIPVPTPKANELLINVKYSGVCHTDLHAWKGDWPLDTKLPLVGGHEGAGVVVGMENVKGWKI GDFAGIKWLNGSCMSCEFCQOGAEPNCGEADLSGYTHDGSFEQYATADAVQAARIPAGTDLAEVAPILCAGVTYK ALKTADLAAGQWVAISGAGGGLGSLAVQYAVAMGLRVVAIDGGDEKGDFVKSLGAEAYIDFLKEKGIVAAVKKATDG GPHGAINVSVSEKAIDQSVEYVRPLGKVLVGLPAGSKVTAGVFEAVVKSIEIKGSYVGNRKDTAEAVDFFSRGLIKC PIKVGLSELPQVFKLMEEGKILGRYVLDTSK | 46 |
| FAO1 fatty alcohol oxidase (Candida viswanathii ATCC 20336) | MAPPLPDQVDYKHVDTLMLLCDGIIHETTVDQIKDVIAPDFPADKYEEVVRTFFIKPSETPGFRETVYNTVNANTTDAIH QFIILTNVLASRVLAPALITNSLTFPIKDMSLEDREKLLASWRDSPIAAKRKLFRLVSTLTLVTFTRLANELHLKAIHYPGRE DREKAYETOQIDPKFYQFLEKPKFYGAELYLPDIDVIIIGSGAGAGVVAHTLANDGFKSLVLEKGKYFSNSELNPDDKD GVQELYQSGGTLTTVNQQLFVLAGSTFGGGTTVNWSACLKTPFKVRKEWVDEFGVDFAADEAYDKAQDYVWQM GASTEGITHSLANEIIIEGGKKLGYKAKVLDQNSGGHPQHRCGFCYLGCKHGIKQGSVNNWFRDAAAHGSQFMQQV RVLQIINKKGIAYGILCEDVVTGAKFTITGPKKFVVAAGALNTPSVLVNSGFKNKNIGKNLTLHPVSVVFGDFGKDVQA DHFHNSIMTALCSEAADLDGKGPCRIETLNARPIQASFLPWRGSNEARRDLLRYNMVAMLLSRDTTSGSVSAH PTKPEALVVEYDVNKPDRNSILQALLVTADLLYIQGAKRILSPQAWVPIPESDKPDKRSIKDEDYEWRAKVAKIPFD TYGSPYGSAHQMSSCRMSGKGPKYGAVDTDGRLFECSNVYVADASLLPTASGANPMVTTMTLARHVALGLADSLK TKAKL | 47 |
| HPD1 3-hydroxy-propionate-dehydrogenase (Candida viswanathii ATCC 20336) | Mlrssvrtfstgsrvlanyyfvglmgqhmarhvynqlqpadklyvhdvnpqhtqfvtdvttqkpqnatqltplsslkefttepesqldfivtmvpegkhvavvsel vdhynasqhkydpsklkltfvdsstidiptsrevhqlvadhlqgatfidapvsggvagarngtlsfmvsrdtkedvdpnlvtllnymgsnifpcggthgtglaaklannylla itnlavadsfqlansfglnhlqmyaklvststgkswasvdncpigvvypeknltcdngykggfvtkltrkdvvlatesakanngflmlgevgrywydkacedekyanrdl svlfelgdlkk | 48 |
| ALD6 malonate | Mlsrvlfktkprvptksitamairnksivtlssttstyptdhttpstepyitpsfvmnefiksdentwfdvhdpatnyvvskvpgstpeeleealasahaafpkwrdtsiikrq | 49 |

TABLE 18-continued

| Gene (Organism) | Amino acid sequence | SEQ ID NO |
|---|---|---|
| semialdehyde dehydrogenase (Candida viswanathii ATCC 20336) | giafkfvgllrenmdriasvvleggktfvdaggdvtrglgvaeaacnitndlkgeslevstdmetkmireplgvvgsicpfnfpamvplwslplvlvtgntavikpserv pgasmiicelaakagyppgvlnivhgkhdtvnkiiedprikaltfvggdkagkyiyekgsslgkrvganlgakmhlvvlpdahkgsfvnavngaafgaaggrcmais vlvtvgktkewgdvikdaklIntgsgfdpksdlgvinpeslraeeiiadsvangavleldgrgvrpedarfakgnflgptiltnvkpglraydeeifapvlsvvnvdtid eaielinmkygngvslftssggsaqyftkridvgvginvpipvlpmfstgsrgsfigdlnfygkagitflkpktitsawktnliddeiilkpstsmpvqq | 50 |
| ECI1 enoyl-CoA isomerase (Candida viswanathii ATCC 20336) | MSDESDILYEVRDRTAIITLNIPKRLNALNGAQYLKLGKFLERANNEEDTVLTLIQASGRFFSAGANFADNDMAKVEM SKLFSHEYWLERFVARNIWLTNLFNDHKKILAAAVNGPVIGLSTGLLLLVDLVVHDLNKFYLLAPFANLGLVAEGASS ATLFNRLGWSKASEALLLAKPIGGQDCYNAGFINKHYDGKFSSTEEFNEHVYKELTEAFENLHDDSILQNKQLLKLSR DQAIN | 51 |
| ECI2 enoyl-CoA isomerase (Candida viswanathii ATCC 20336) | MSDDLITYEVKDRAAVITLNNPKKLNALSIPQYDTICKLLERANAEEDTVITLLQSTGRVFSAGANADSIVGQDAELET WLNMSVAKQTFLVQTFLAHKKILAVALNGPVIGLSAAFVALCDLVYVHNAAKTFLTPFANIGILAEGGTSATLPMRVG WSRAAEALLLSKRISGDDLQRAGFPNKDYKGQFKSAEEFNEVVLKELLDATENLHEDSIIQNKELLKAIFKPKISEVNS QEVSRGVYKWTSGVPMDRFKKLLNGELKHKL | 52 |
| DCR1 dienoyl-CoA reductase (Candida viswanathii ATCC 20336) | MPNTLDHNYLKKSVWKSDIPAGKVIFITGGAGTICRVQABAMVLLGANAAIIGRNVEKTEEAAKEIASLRPGAKVIGIGA VDVRKIQTIKDAVDRTVAELGRIDYVIAGAAGNFLCDFNHLSANAFKSVIDIDLLGSFNTVKVTFDQLRKNKGAVLFVS ATLHYTGVPMQSHVGAAKSGVDALSNALAVELGPLIGIRFNCIAPGAIAGTEGMSRLAPPTDTPLETKIPLQRQGTTED IADATVFLFSPASSYITGDVLVVDGAMWQTGGGILNDFYPDIIIHQNADPEGKL | 53 |
| DCR2 dienoyl-CoA reductase (Candida viswanathii ATCC 20336) | MPNTLTEAYKQESSWKPDLFKGKVVFITGGAGSICRVQABAMVLLGANAAIIGRNVEKTESAAKEIASLRSGAKVLGI GGIDVRKVDSLKSAVDKTVAELGRIDFVIAGAGNFLCDFNHLSSNAPKSIIDIDLLGSFNTVKVTFDQLRKNKGAILFV SATLHYYGVPFQIGVGAAKAGVDALSNALAVELGPLGIRSNCIAPGPIDGTEGVERLVRASKARAAKKVPLQRIGTTQ DIADGTVYLFSPAASFVTGDVLVVDGASWQISSGVGATNYPVSIINAIDAPKGGKL | 53 |
| MCR malonyl-CoA reductase (Sulfolobus islandicus) | Mrrtlkaailgstglvgieyvrmlanhpyikvgylagkgsvgkpyeevvrwqtvgqvpkeiadmevkptdpklmddvdiifsplpqgaagpveeefakhgfpvisn spdhrfdpdvpllipeinphtisllidkqrerhdwrgfivttplctaqgaaiplaplymfridsslitiqslsgagypgipsldvvdnvlpigdnydnktvkeisrilsetkrmv nddndlsgatthristihghyevlyvtfredvsvekirieteldsfrgepqklkiptapdkpillitnqdarpqvyfdrwagdppgmsvvvgrlsqinrrtirlvsvvhntvrgaa gggilaaellvekgyidkr | 322 |
| 2PS 2-pyrone synthase (Gerbera hybrida) | MgsyssddvvireagraglatlilaigtatppncvaqadyadyyfrytksehmvdlkekfkriccektaikkrylaltedylqenptmceFmapslnargdlvvtgvp mlgkeaavkaidewlpkskithllfcctagvdmpgadyvlkigispsvvrvmlyqqgcaaggtvlrlakdlaennkgsrvlivcseitailfhgpnenhldslvagalf gdgaalivgsgphlaverpifeivstdqtilpdtekamklhlreggltfqlhrdvplmvaknlenaaekalsplgitdwnsvfwmvhpggraildqverklnlkedklra srhvlseygnlisacvlifidevrkrsmaegksttgegldcgvlfgfgpgmtvetvvlrsvrvrtaavangn | 324 |

Example 26: Nucleic Acid Sequences of Genes Referenced Herein

TABLE 19

| Gene (Organism) | Nucleic acid sequence of the gene protein-encoding sequence (from START codon to STOP codon except where otherwise noted) | SEQ ID NO |
|---|---|---|
| URA3 (Candida viswanathii ATCC 20336) | Atggttagcacaaaaacatacacagaaagggcatcagcacaccccccaaggttgcccaacgttattccgttaatggagtccaaaagaccaacctctcgcc tgatcgacgtgaccacaaccgccgagttccttcgtcatcgagaaggtcgtcccacatctgacaagctcggtttgaagagctggcacatcgatatcatctcagacttcagctac gaggcacgcattagccctgctgctgctgctgcagagcgcacggttcttgactcgacaggagtttctgatatcgaaacaccgtatgtcgatacacc tcggggtataccgatcgcggcgtggatgacatcacgacgacgccgagtcgttggcgcatggaaggcatgaatataccgttgaaggttgaacaccgtgaaccgtgcggagggta gaaagagcaaaggggcgtgatgtttgatgttggcagcggggacgctgccgagtaaggctcgagatcgagattcgttgaaggtatgatataaagcggatcgg gagtcgcgcaacgcgccgaactcgagtccatttggagctgcaaggggaaaagtttccatcccgatcatacggtggttgagctggtaagcgatgcgatgc gtcggcacgatataggacgtttgtgactgttgaccgatttgattattgcgggagaggttgttttgaagaggaacccctgaggtgagg gaagagatacaggagtgctggatggaaggcatacttgaagaagaactcgtcagttagaataa | 54 |
| P<sub>URA3</sub> (URA3 promoter from Candida viswanathii ATCC 20336) | cgacgggtacaacggagaattgtattgattgatcaagaacatgtcttggttacagaacatcaagttcttggaccagactgagagatgcacagatacaaggcgt catgtgataaaatggaaggtgagatttatccacaattgaagaagaagtgtcaacaagaaaagaagcaacaagaaggatgaaaca agaagaagtgtaaataagtatttgtattattaacaacaaagttaaggaatacagttatacaataaatgcctactcgtactacaccaatcctaaagacccccatttcatccccgcc ccaactcccaagaaaaaaaaaatgaaaaaaaagtgaaaaaaaatcaaaccccaagatcaacctcctcatcgtcatcaaacccccagtcaattcgca | 55 |
| T<sub>URA3</sub> (URA3 terminator from Candida viswanathii ATCC 20336) | Taaatattgtaataaataggtctctataatacactaagcttctaggacgtcattgtagttctgcgaagttctgcatgttagtctttccatattcgaaaccaataacgca atggatagcagggatggtgagtcgtcctgacaaaccagtagccgcctcaaaccgtcatctcgccctttgtatccgtccttgcttgaagg tatccccagtacgagttgtaatacacccttgaagaacggcttcgct | 56 |
| P<sub>URA3</sub>-URA3-T<sub>URA3</sub> (sequence of each element from Candida viswanathii ATCC 20336) | ttaaaggtatctacggttgtttccggtgatgacaccccgggggatcgacgggtgacgggtacaacggagaattgatgtgaacgagaacatgatctgttggtgttacagaacatcaagt tcttggaccagactgagaatggcacagataaccaaggcgtgaaacaagagaagaagcttctaaaaatgatgagagtttctccacaatggaagaagtgaagtgaatatacaga agctaacaggagagcaaaccgcgttcaatgaaagaagaaactcgtaagtccccaactccccagaaaaagtgaaaaataatcaaaccaaagaatcaacctccccatc ataaattgcccatactagtcactgagattgcccaatggttagcacacccccaagtgcaccaccccccaaggttgtccaacgttattccgtt atctgtcatcaaacccccagtcaatcgcatggtcttcgaggtttccaccccggtttttcgcacgaggccatggaatacgcaagttgatatccagttatggctccaatc aatggacgaacccaaaagaccaactctccaagtccgcctgacaaacccgaaggcatgaatgatgtttgcctcgagaccggttagaagcgccagaaggttgatataccg gaagggttgaaacgcgtggaagggtgaaaagctgaaaagaagtcgcgaagggtcgtgcgagtgtgccatggttgcgttgccatggttgccatggtgaatatacccg tgagacgatcgaattgcgaagatgcgatgatagaaggcaattgaggtcagcgcagtgccaaaccgagagtttcatcgcacacagtggtccagttgaaagcgatcatcgacg cctggtgggtgatgatgtagagagcccgaagtgggggaagagacaaggagatctcaaggacgaatcgtggaggaactgcactggaagtcccaagcatcgcaagttcatcgttctggagcagagttcctgaagattctcattgttctcatccattgcttcatccccatcactcgttgcttcatccactgcttcatcgagt tgtaataaccttcagtcgtctggaagaaccgcctctgtcgtcgactgtgatggcatgcttgattatcaagtggattctgatcttgttagagtacagaacatcaagttcatt ggaccagactggaatcgcagatatctcaaggcgtcagtgatatacaaggtgaaacaagaagagaagagtttatgaaccaatgtcatgatggttgtcaccagagc taaccagggcaacaaagagctgagatattcgagattcctccaagaaaaagaagtaaatggattattatataacaaaaaatcaaccccaaagtcaaccccaatc aatgcatactgtcacgtgagatatctcatccattcgcagagctcggtacc | 57 |
| T<sub>URA3</sub>-URA3-P<sub>URA3</sub> (sequence of each element from | taaatattgtaataaataggtctctataatacactaagcttctaggacgtcattgtagttcttgcgaagttctgcatgttcgaaaccaataacgcaa tgatgtagcagggatggtgagtcgtcctgacaaaccagtagccgcctcaaaccgtcatctcgccctttgttcttcatccgcatcactgcttgttcagaagtt atccccagctcgagttgtaatacacccttgaagaacggcttcgctgctcccacgaaagccatatgaaatgatgagatttctctaacaatgctgaaaatacatcca agtctgtggaccagagagaaacaaggcagaatgcagaagatgaagtgcatgtgataaaatggtaagaatacagttata gagctgtaaacaggtaacaggtcaaacgaggaacaagaagaggtgcaacaaagttaaggaatacagattata | 58 |

TABLE 19-continued

Nucleic acid sequence of the gene protein-encoding sequence (from START codon to STOP codon except where otherwise noted)

| Gene (Organism) | Nucleic acid sequence | SEQ ID NO |
|---|---|---|
| Candida viswanathii ATCC 20336 | caataaattgcatactagtcacgtgagatatctcattcccaactcccaagatcaacctccc atcatcgtcatcaaacccccagctcaattcgcactgctacccaaaaacatacacagaaggc atcagcacacccctcgagttgcccaacgttattcc gcttaatggagtccaaaagaccaacctctgcctgatcgacgtgaccaacaccgccagctgtccttcgtcatcgacaagctcgtcccacatcgtctgtg aagacgcacatcgtatatctcagactcaggggcacgatgagccgtgctgttgtctgagaggcacaggggttcttgatattgaggacaggaggtt gctgatcggaaacaccgtgatgtgcagtacacctcggggtatacgaaggaaaggggcgtttgatcgtggaggtgtcgagtgcgagatcgtgatcgatcaacatg ccgttgagggttgaaacggtggtgcgagggtgatggggagagaagatggtgatggggcatcgttcatcgcgcagcggacatgggggactgagaaggtttgattgatcatcatg accgtcgtggggtggaatgatcaaagcgatgggttggggctgcagcatagaagatgcgcagcatcaggggatgctggatgaagagactgctcagttcatctctcagattctgagaaaacaatcagtcaatgctacgtgtt aataggctatatacatacaagtctaggacgtcattgtactcttcaagttgctctgtagttagtcttcaagacactctcctcagaaccaataaccaatggatgagca gggatggtggttagtggtggtcctgacaaaaccccagagtacgccgccctcaaccacgtcacattcgcccttgttcatccgcatccacttgttgaaggtatccagcacg agtgtaatacaca | |
| CAT2 (Candida viswanathii ATCC 20336) | atgtttaacttaagtgtcgcaacaagtattaaagaattccaccaaatccattatgccaatttgaaaaaccatctccaccagccaccaccaaagggtgactgttcaa ataccagtcacatttaaccaagttgcctgtcgttcctacttggaagaaaacaccgctccaaagaccgttgagccattctgaccaagagcaattggaatccac caaggccaaagtgcgagttgttcaacccagttgtgccagttgcaagccagattgcaacctcgccgacaagcagatcattcagtcacaaggatgtcaagagaccaattgttgaaggc gggacgactatgctacatgtcttatagagatcctgttgttcctcatattgttctatactctggtgacgaaagttgaccaagaagttcatcaaggatgtcatcaagatctgatgaacaacttctacaag tgtccaaacccgagagtccagctgaaggtccgacatccaaagttctcgtttgctcatcaagaacaacaattttcgttgtcatcacaagaacaacttctacaag gttccacaccccaaagagtccacagaagattgcaagatgcctacaaggtctactgaagtccccaatcaacgaagtctgttgaagtaccaagtctgaagattcctgatccattgcctcatcttgctctcagtttgctcattgcct ggactccaaacaaccagtcaccatttgaagaaaaatccaagatgggagaccactccagatcggcacggccacccaaccaaccacagaactgtcgacaccacacaagaaacaaagcgcaatttggaaactcaagcaaataattcaaagacg acgtaactcctggttcctggtgaaattggtttctctgcccacagttggctgggtcaccaaacttgttcaccaccaagagaagagcacacatccaaaaggcgttatgccaag actgattgttgaaattgttctctctgccccacgaaagaatcttccaaacatacgttgcaaggatgcaaccagcactcaaggtcaggtctgttgacttt tttgacgccaccattgcgcccacgacagaaaatcttccaacgacatacgcttacggtaaggggtcaaggagttcatgacgacggttgctcttgctgactactgctgactactagatcaacaa ttgatgcaattgcatacttcaagtacaccgccaagatcagacaagatcagaccgcaaactatgaatcgccagcaaggcaactacctgaagggtagaacccggtaaagtc gttccaacgatccaagaagttgtgacgagtttgttgagaccggtcgacccactcttgttgagctgccactccaagacgtgcaacacgtgctta cttgtctgctgccgcgatggtgaaggtgccaaggtcgaccgtcggttgaagcagatgattctccaatctgggttggcgcaatgatcagtcgttgcttgctgactgatcaacaac ctactccaaacctgcaaggtcacgttcaattcttcttcctgtgagagagaatccatcgggggcttgaatccaaatcctgtcgtttgcttgctatactgatcaacaac gactggatccacgtcacattcttgtaagaggagaacggctcaatccagccttgcaatccgacacttgaaatggtactgttgtaatggtactgttgtaacgaaatgaagactcttgactaa gggattattgactgatgctaagcctaagttgtaa | 59 |
| Engineered DNA fragment CAT2$\Delta$ms | atgccaatttgaaaaacatcttccaccagccaccccaaagggtgactgttcaaattaccaagttgctgttcctacttgaagaaaccgcat ccagtacctccaagaccgtgaacaacttcttgaaccaaagagcaatggaatccaaagagctgatgtcgtgagttctgattccagcagtggtccggtgaagcctt gcaagccagatgaacaactgccgccgacaaggaacaacttgttgctgctatgcatcacatgtcttatagagatcctgttccatatgttcttac ttttcagtcacaagctgcatacagtgtccagaaccatcggtcagaactcaatgcaatgcatgcatgcttatgcaagaagagttggaccaagttggactcaaagt ttgaccccagagtgaacaactcctaaggaatccaatcaatgtgttgtctactctactatcatggacttgcctccaacccaccagcacagcagccgacatcaccaacacta caaggtgaaggaaaccaatctcctacttgtcactacaagaaaccacttctgtctcagatggtgcagaagatgtcagcagaagaccgcaaggttgaaatctcag ctacccaatcaccgaagtctcttcgggatccatcctctgttctgcaagttctcgtcaggtgactccttgcaatgctcccaagaacctgtcgaacactccaagatactccaggttgaa acgggtgcaaaagagatgtcaacactctcacaagccatgaaagccctgaacgcggtaagcaacgtggtctattgaaccatcaacgctctatgcagaccttgaacctctgatcgatttccaagatcgcaagtgttcagatcgcaatcttgc cgtcaattgaacaacaccatcgaaagaccgctatcggccaagatcaacactatggttgacacttgaccgaaaggttcaagggaagaatcttccaacctacgtta ctttcgactcaaccacctcaaggtctgaccatgctctcaaggtctacgtgcatcgtcaagctactgcaccgccaagtaccagcaactagacttatga cggtaaggggtgatgcaaggtcaaggtctgcattgcatcgtcgatgctctaacaaggtccttgagagccttgttggaccgtactcccaaacgctga atcccgcccacaaggttgcacttcaagggacaacaaccttcacgtcgcgcccatgtgaactagtcttctactgcgccgatgctgtgaaggctggtctaccccaac agatgattcaaccaggtgaaccaatctcactgaaatcttcactgatctttagctattccaagctgtacatttcttcttcttcttcaatcttccaattctt ggggtgcaaggtcattgacgacggttcggtttggctactgacaacgacctgatcttctactaaacaacgacctgatcaacaacgatctgatcaaccggttggctaa cacttgaatggtactggttgatagtgctaacgaaatgaagtgcttaacgatgaaattgatggatgatgatgatcctaagcctaagttgtaa | 60 |

TABLE 19-continued

| Gene (Organism) | Nucleic acid sequence of the gene protein-encoding sequence (from START codon to STOP codon except where otherwise noted) | SEQ ID NO |
|---|---|---|
| Engineered DNA fragment CAT2^Δmis Δpss | atgcaatttgaaaaaaccattctccaccagccacgcaaaggtgacttgttcaaatacccagtcaccaattacccaagttgcctgtcctactttgaagaaaccgcat ccaagtacctcaagacctgagccattcttgaatccacaagagcaatcggaatccacaagccaaagtgcagttgttgaccaggtggtgccggtgaagcctt gcaagccagattgaacaacttgccgccgacaaggacaactggttggctgagttgcatatgttggacgatgcataactgtcttatagatcctgttgtccatatgttcttac ttttcagtcacaaggatgtcaagaacatcattggccaagaccaattgctgaaggccaattgtactactaccatcgagagttcaagaaaagtttcaagacgaaagt ttggaccagaagtcatcaaggtaaccattctgtatgaaccgcctcaagtacatcgagagttcagctgaagtccagcatcaccaaggtctacaacactacag ctactcagcacacaaggaacgcaagaacgatgccactccaaaggtgcactctccaaaggtgccttggtgtccgttggtcttgacctcatcgagtgcctacaacaacttgttgaa gtcccaatccacgaagctccttggatccatctccatcgctcttggattcctcttgcctggaatcagcaccttgaagacactgaagaaccaagaactgctgc acgggacggtcaaaacagattcttgacaagccttggaatctctcgtcagtgctaacgtcttcctgttgtaacactcaagttggcaatgagctaccaac cgtcaattgaacaaccactcaacaagaaaactcaaagacgctgccaggttgcaagttgacgacagaaactcttccaacactacagcc ctttcagatcatcaaccaccagaccaaatcaaagagctcctgcaagttgcccagattgcgacgacgagaaatctcccaaacactacagcgtta cgtaaggattgacaagcctcaagctccccggatgctgccctcccagatgctatgctacgaatgactaccaagaccaactatga atccgccgacacaaggtgccacttccaagctgcgaacgtccaagctcgccacagttcactcgcatactcacccaaaccggtacattctccccaagtccccattcaatcttccaatctt ggggttgtcgcaaggtcattgacggcaagttgcactgacgacgtttccgcaaggtccattcaccaattccttgaagaggttagcggttgaatcgac cactgaaatggtactggttgatagtcctacaagaaatgaaggatgtcttgactgatgctaagtaa | 61 |
| Engineered DNA fragment CAT2^Δpss | atgtttaacttaagtgtcgcaacagtattaaagatctccacaatccattatgccaattcgaaaaaccattctccaccagccacgcaaaggtgactgttcaa atccactcacaagtgctgttaccccaagtgcctgttcctcaagtgaccaccaccaagtaccaacagtacagtacagccgtgaccattgaccaagcttgaatccaac caaggacgactaccaagttgctgagttctgtagacaggtggtccaggcagctgaagctggtgcgtgaaagcaggacagctgcgacagaaacaacttggctgttgctgatttt gggagactatgatcatatgtcttatagaatctgaattgatgtccattgttcctcatttctcagtcacaaggatgtcaaagacaatcattgccaagacatattgcccagtaca cactttgattgttcactacacattggagttcaaagacaaaggttgacccaagtctacaaaggtcatcaaggttaaccatctctgatgaacgcctcaagtaca tgtcacaacactcaaggtccgagagtccaggtcgaacctccaacaccacaacactcaagctgtaccaacgatggccaacaagaagctacagaacaacttcatcacag gtccaaccaccaagagaacggcaaagatgacaagcaaatggtgagaaaatcaaaggactgctgcactgcacccccaaccgtgaaccgtaccccaaccgcttccggtaaggacg tgacctcaaccaacccaaccctcaccattgtccaaacactctggaccaacacccagatctttggaccaaacctttctaaacactctggaattcttgacaagccttggaattctcgtcagtgct aacggtaactcggtctcctggaacccaggggaatctctcagaatggtgccgcaagccagcacaggctgaaatctctgcaatccctgaattccacgacagtgatgaccaacatcaaaagactcactgaaccaatccttag acttgattgtgaaatgttctctgctccaaggttcaagaccagcactggttgcctgcaacaattggccaacatgaatgattccaactccaaagaagaagaatctcctgaatctctcactgagaaccgtattgccaag tttgacgcaccattgctgccacggagactcaagtacaccggcaaagatcagaccagatcgaaatcccaaaggttacgaagttatgaatccggccgacagctagcacgccgcgacaaggttgtgcacttcccaaggtgcctaagcacacgttgtta tgatgcaattgccatacttcaagtttgtgaacacccaagatcagcaagtcagcaagtgccaagcccagccaactatgtaacccaaccaaggattgctgtctgccgcaagtgctta ctgttgccgcgatggtgaagcgagccatgccaggtgcacttgttcgtcgcaaggagatgaatgattccaacctagcaagcacatcaaagagcctatgccaag ctattctcaaactggtacattctcttcttgaagagaggaacggctgcatgcaatcagaacaccactgaattctcccaaccactgaattgtgatgacgacggttcgttggctgatcaacaac gactggtccagttcactttccattgttgcttaagcaaggttgaatgcgtattacagattatccttacccaagaaggcg | 62 |
| YAT1 (Candida viswanathii ATCC 20336) | ATGTCAACTTACCAGTTCCAAGAACTTTAGAAAAGCTTCCAATCCCAGACTTAAACCAAACATGCGCTAACTAC CTCAACGTCTTCGCTCCGCTCCAAACAGACCAAGAACACATCAAGACCAAGACTGCCGTTGAGACTGAAATTTCCTCAA GAATGGCACCGACCAGTACCTCGACCTGCCTTGCGCGAACATACGCCCAGACCCGCCCAGCTACATTGAACA GTTCTGGTACGACGCATACTTAAACTACGACTCCGACTGTGTTTTAAACTTGGAATCCGTTTTCTTACTGAAGA CGACCATTCACCAACGAGCTCCAGTCCGCTCAATCCCCAGGTTAAGCGTGCCACCAGTTGGTGATGTCCTCG TTGAAGTTCATCCAGGCTTGAAGAACGAGAACGTTGGGCGCCTGTATCCCCTGCCTATGCTCCAGTGTTGACCTGTTGACGTGATGCAAGAACACT GGCAAGTAACCACCATTGCTGCGATGCTGAAGATGTTGAACTTCCAGTCCAGTGTATTGCTTGAGATCATCAAGATCTCCTCGGAT GAGATTGCAAAGCTCTTTGGGAGTTGAATGCAACGAGAATAGAAGAATTTGGCTAATGTTAGACATAATTT GATGATATCGATTAATAAGGTTAACCATGAGGTGTTGCCAAGAATATGCTTGTCAGCGTTGTTGTGTTATGCTT TATCCAAGTGGTACTTGTACAAACAGATGTATGACACAGTTGACAGTTGCAGATTATCCTTACCCAAGAATGCCAAGCCG | 63 |

TABLE 19-continued

| Gene (Organism) | Nucleic acid sequence of the gene protein-encoding sequence (from START codon to STOP codon except where otherwise noted) | SEQ ID NO |
|---|---|---|
| | GTATTAATTTCGAACATACTGTGTTGACGGTCATACGGTGTTGAGATTTGTCAGTGATATCTACACCGACTCCA TCTTGTCCTTTGCCAACTCCATCAATAGCAACGCTCCATCTTTATGGAACACCACTACCAAACTACAAAGAACTTG ATGGGGAAGATTTAATCACCGTCCCACGTAAGTTGGAATGGAGTTGACCCCTGACTTATCCTTGGCTTTGAGA TTTGGAGAAACCAGATTGTCGGACTTGATCAACCAGAACGAGTTCCGCCACTTGGAGTTCAAGAACTATGGGTC TACACAAATCAAGAGAAGATGAAGTTCTCACCAGATGCGTTTGTTCAAATGGCGTTCCAAGCAACCTACTATGCGC TTTACGGTAAGGTTGAATGTACTTATGAGCCAGCCATGACGAAGCAGTTCTACCACGAAGAACAGAAGCTATA AGAACCGTCTCGCAAGATTGTTTGTCGTAAGTTCTTTGACTCCTGTTCCATCCAGAAGAAGTT AGAGTACTTGACCCAAGCTTGCACCAAGCACTCCAGAAACCAGAAGAGTTCTGCCGGTCAAGGTGTCGAT CGTCACTTGTATGCTTTATTCTGTATCTGGAAGAGATACTTACACGATGCCGAAGACCGACGATGCCTC CAAAGACCAACCATCATCGACGAATTATCCCGTGACCATCATTGCTCAAACAACCGTGACAGCACCG ATGATGACGACTCCACCACGTTGTCGACACCGCGCCAACCACCATCACAACTTGAAAAGCGCCGATTTGTT GAAAACCATCCCTGAGATATTCGCAGACAATGCGTGGGACAAGTTGAACAACACGATCATATATCCACCTCCAACT GTGGTAATCCTTCTTCTTTGAGATTGTTTGGATTTGCTCCCTGTTTCAGCTAACGGGTTTGTATCGGTATATCTTGA AGGACGACTCGATCTCGATCTGTCTTCGTCAGAAGCATCGTCAGACGCAGAGATTCTTGTCACTTTGAACTCG TACTTGTTGGAGATCCAGAACATCTGGAAACAAGCGCAAAAGATGGAAGAAGTTGAAGGCTGAGTTGGCTAAAG CCGTCGAGGATGCAAAACCTAAGGGACAAGAAATCAGGTGAAGCAGCAGAATCGGTAAGCCTAATAA CTTGAGCCACTCCGTTCTTGCATCGTCGTGATCCGTTTCAGCATTCGTGAAATAGGCAAGAAGTTGAGATTAAGC GAGTATTAG | |
| COX4 first 90 nucleic acids encoding mitochondrial targeting sequence (Candida viswanathii ATCC 20336) | Atgctttcccgtaccactta TABLE 19-continued

| Gene (Organism) | Nucleic acid sequence of the gene protein-encoding sequence (from START codon to STOP codon except where otherwise noted) | SEQ ID NO |
|---|---|---|
| Engineered DNA fragment YAT1+COX1mts | atgcttcccgtaccacttaagagtgtcagacaacaaaccagattattgtctacttcaagaatttgttcaacagcaagaccgaccaatcaacttaccagttccaag aaacttagaaaagcttccaatccaagctcccagactaaaccaacatgcctaactacctcaagtctgcgtccgtccaaacagcaagaacacatcaagacaag actgccgttgagaattccctcaagaactgcaccgcagtacctgaccgtgtttaaactgaatccgtttcttactcgacgagaacgaccattccacccaaggtctggtacg acgcatactaaactgactccccgtgttgaagttcatccgtgaagtctcccgtatcccccaggacgggtgagcgtgagggagcaaggaccttgagcgtcgacacattgaaacagtctggtaccag gtgcacccagctggtgatgtcctccgttgaagttcatccaggcttgaagacagcagagctgagcgtgacaccttgaaagagggcaagcgttgtcatgtaccag tacaccaaatttgttgggcgtgcgtgacaaaatcttgattttgacgaagctgagcgaagtgaaatccaggtaactccagttgcgtgatgtcttaagtccagttgtatt ggttgacgtgttggatagccaagaaccctgattttgagcagagcgaggttgaatgtgaaacttcatgactcttgagaactccctcgatgagattg caagagccgttgggttgtgacgacggagacgagaaggttggcaagacagcagtgttgattataacagctgaaagacttagcacataagggtcgtgtc gattaatgactcagcgtgttgttgtatgctgatgatcttgataatagacttgaagacctcttgccaactccatcaagacaggatgaaaatagcttgtttgggtgttccatttttgacttgacgtgcatgagcatacgtgttga ggtacttgcagtgatatctcacacacgacctgcttcttgtccaactccatcaagcttgttggaacaccaccaactaaaaactacaaagaaacattgatggg gagattcaatcacgctaagtgactgcatgcatgtatttgacagcagaatgtgcctgagagacatgactctacagccttgacccgctcaacaccaagacg agtccgccacttggagtcaagattgtacctatcagaatgaagtctcaccagatgcgtttgttcaaatcgctcttgtgcaagatcgaactcttactgcgct ttacggtaaggttcaatgtactatgagccagccacctaccaagaaagtagagtcttgaccactcccagcaaccaagagagctctgcgcggtcaagtg gtcagtgtttttgactccactgtgtccatccaggaagttagaagatcgcctaacggagatatcttacgagtgacactcaacatcatgcagacgaatatc tcgatcgtcactgtacttttatcttatcgagaagatttacggagtaacaagcgcttcccaagaactgcgagatcttgaaagcaagcagaatgcagcttacgacgatgatgataaagctcctgtccatcatgcgcggtcacatctctaggggtcgagaaatagcgcatacaaggatcataagtaaggcgcaactggatcgcaaaaggatcgtctttcagtcgctcgttgaaagcgagtgactcggggggagaacttccatcagccgctattgaaaatcaccacatcacgtgtttcaaactatcgtatcgagaacggttgagatggtgcaggtggaagtcaaaagagctcgttg tcagtcgcactgtacttttatcttatcgagaagatttacggagtaacaagcgcttgcgagatcttgaatatcgatatatc tacaccgactccatcttcgccttgccaactcaattagcaacagctccatcttatgaacaccacatccaaagacactaacaaactcatgtgggaagattaataaccg tgccactgaagttggaatgggttcatacgaagaaggtctcaccctagatttggagaaccagatgtggagctgtgatcaaccagtgcccaaccccaagcttcagcatcagaatatgccatcgatctccatgcgcttcaccctggaaaggcc gtcaagaaactatggctgtctacaaaggaaatccagagtaaacaacgtcgataaggtattaagaaacgttcaccagcaaatgcttcagtatgggttactgcaagtgtcctcactgaatcc actgtgtccatccaggaagttagaagatcgccctaacggagatatctacgagtgacactcaacatcatgcagacgaatatcagtcgatcgtcactgtact gctttatctgatcggggaatcctgaaacagcaaatctgaaactgcaaaaggcagaagttgcgctaagttatgatcgttattttgataatgacttgaccagcg cattgccaagcgtgacgacgacagaacatgtgacagccaagttgaacaacactgatcgatcgtcgagaagttgtcttgtgatcgtcactttgactcc aaccagctcctcatgaagaaggacaatatcctgaaggcaagcaagttaacacagctatcagaacactccagtcctccaagatatctgttcattttgattgttggtcctgtt tcagctaacggtttggtatcggtatattcttaaggacgactcggtatattaagaagcgcaaaagctaagctcgtgcatattccatttgaactgctact tgttgggatcaagaagcagaggggaattgcagcattccagcctaacttgctacctaaatagcaggatatattggttatttgttgatttcgatacgacgatt tcaagcgtgagcggaactgagaaacctagcgtactgttctattgatgattttcaagctagcagatacgccaatatgcgctctatcggcagcagatatcagcagagagactgagaaatctcagcctaacatctgcaaaagcacggggcatatccctaatacgatggagtcagcaaccacaagaacatcaagagcagagg acaatcccagaatcccgttcttgcatcgtctgctgcatggttcagcattcgtgaattgtgagaattgagatttaagcagtattag | 68 |
| Engineered DNA fragment YAT1+CAT2mts | atgtttaacttaagtgtcgcaacaagtattaaagaattccaccaaatccattatgccaattcattttgaaaaaccattctccaccagccaccgcaaagggttcaacttacca gtccaagaaacttagaaaacgttccgttgaaaaagcttcaatcccagattaaaccaaccgcttaaccaacaaccagcttgtccgtccgctccaaacagagcaagaacaatacaa gaccaagactgccgttgaatcttcctcaagaatttcctacgaccggcagtacctgcgcttgccgaatacgcccagctacattgaacagtt ctggtacgcgcctgcccagttcccaacgaccggttacactcgatgaagcgtgctactgacaaaatcctcaccgatcgactgaccacaattaccga | 69 |

TABLE 19-continued

| Gene (Organism) | Nucleic acid sequence of the gene protein-encoding sequence (from START codon to STOP codon except where otherwise noted) | SEQ ID NO |
|---|---|---|
| Engineered DNA fragment YAT1 *tps* | ggtaagcgtgccaccagcttgtgatgtcctcgttgaagttcatccagacttcatccaggcgttgaagaacgagacgttgagcgtcgacacccttgaaggaggcaagccgttgtgca<br>tgtaccagtacaccaaattgttgggcgctcgtagcgcaagagaacaactgattttgagcgaagcgggtgtgatgcagacgccagaagtgtcgtgatgtcttgatgtctaagtcc<br>agtgtattggtttgacgtgttgacgttggatagcaagaacaactgattttgagcgaagcggagtgaactcgagtgactccgatcattcatgactcttgagaactcctcga<br>tgagatgcaaagagctcgttgggtgttgacgacggagaattgggcactgatcgtagcaactaattgatgtcgctaccagacctaccaataatcaaggttaaccatga<br>ggtgttcgattattgactcagcgttgttgttgtgttatgtgatgatatcgttacagaagtgcagattatcgttgatgatatcgtgttccaagaatgactctgtagctttgatgttgtccatttggatcata<br>atccaagtgggtactgtacaaacagatgtgtacgagtgcagaagttgcagaattatcgttccaactccatcatagcaacgtccatcttatgcaacaccactacaaagaa<br>cgtggtgagattgtcagtgatatctcacaccgactccatctgtcdttgccaactccatcataagcaacgtccatcttatgaacaaccactacaaactacataagaa<br>ctgatggaagatttaatcaccgccaagtgatgtgaccccgtactgtcatggtgagaaaccagatgtcgactgatcaa<br>ccagaacagtccgccactgagttcaagaactaaagaacgtttacagcagccagactgaaaatcaagaagtgtctcaccacgatgaagtctcacccagatatagcgttactgcca<br>acatgcctttacggtaaggttgaatgtcttttgacctcactgtgtccatccagaagagaagttaggatgtactcgaccaagctgcaccaagaatcccagaagaatgatgttctgcc<br>ggtcaagttgcgatcgatgactacaagatactcttactcttccaagaagatcttcaacgatgacgcagacgatgcctccaagaaccaataccatcg<br>acgaatatccgtgatgacaccatcattgctcaaacaaccgtgacgcagcacgatgatgacgacgatccaccacgttgtcgacacgcgccaaccaccatca<br>caactgaaaaacgccattgttggaattgattggtcctgttcagtaaccggttggatcggtatatctcaggaccgactgtgctgtcgcaagcatgcatcgatgg<br>ccttcttgagatgtcatcttgaattgttctgtgaggaagtctctaccagatgacgaagatcctgaactccatcaacctaatactagccttgaaatgagaccgattgttattcgatgg<br>aagatctcttggcacttgacctgtactgtggaagcacagcagcctgatgatgactggaagatgagcatccctttggaggttgcataaaaggcctacacgatctgagccgtga<br>ggatgcaaaacctaaggacagaagcaagcagaatccagaacctccgttttcgcttcagcttcggtctgccgttcaacacaactccatcatagttagcttggtaa<br>cgagtattag | 70 |
| | ATGTCAACTTACCAGTTCCAAGAAACTTTAGAAGCAGAACTTTCCAATCCAGACTTAAACCAAACATGCGCTAACTAC<br>CTCAACGTCTTGCGTCCGTCCCTCCAAACAGAGCAAGAACATCAAGACCAAGAACTGCCGTTGAGAATTTCCTCAA<br>GAATGGCACCGGCCAGTACCTCGACGTCTTAAACTACGACCCCTTGTTTAAACTTGAATCCGTTTTCTTACTGAAGA<br>CGACCATTCACCCACAGCGTCTGAAGAACGAGAACTTGAGCGTCGACACCTTGAAAGGAGGCAAGCCGTTGTCA<br>TGTACCAGTACACCAAATTGTTTGGGCGCTGACTCGTCAAGTTCCAGTGTATTTGGTGATGTCCTTGATGTCTGCA<br>GGCCAAGTAACCACCATGGTGCAGCGGAGTAAGTGCTTAAGTGTATAAGTGAAGGGATGGAGCGGACCCA<br>TGATTTGAGCAAGAGCGAGATGAATGTAACTTGCAGATGGTTAACCTCCGAGTAATGGAAGATCACTGACAA<br>GAGATTGCAAAGAGCTCGTTTGGGTGTTGACGACGGAGAATGAAGAATGATCGTGGCTTAATTTAGAGACATAATTT<br>GATGTCGACTACCAATAATAAGGTTAACCATGAGGTGTTCTTCGAGATTTGTCATTAATTGCTCAGCGTGTTTGATTTTATGCTT<br>GATAGCATTGCTGATTAATGCTTGACCGAGTTGGCGAGTGACCATGGAAATATCGTTTGGATAGATATTGGATAATGG<br>TATCAAGTGGCTACTTGTACAACAGATGGTATGACAAGTTGCAGATTATCTTACCAAGAATGCCAAAGCCG<br>GTATTAAATTTGCAACATACTGGTGTTGACGGTCATACCCGTGGTGTTGAGATTTGTCAGTGATATCTACACCGACTCCA<br>TCTTCGTCCTTTCGAGATGATTGCCAACTTCTGCAACTTGGTTGTCCGAGTTGTGCACAGATGCTTCAGCCGTTGTCCATTTGGATAATGG<br>TATCAAGTGGCTACTTGTACAACAGATGGTATGACAAGTTGCAGATTATCCTTACCAAGAATGCCAAAGCCG<br>ATGGGGAAGATTTAATCACCGTCCACCGTAAGTTGGAGCGTTGACCCGTCGACGTTCGACCGTGACCTACTATCTGAGCTTTGAGA<br>TTTGGACAACCAGATGCGACTTGATCAACGACAAGTTGCAGATTATCTTACCAAGAATGCCAAAGCCAGCTCAGAGCT<br>TACACAAATCAAGAGAGATCCTCTCCAGCAGTGTTTGTGCATCGCTTCAGACGTCCATCCAGAAGAAGAAGTT<br>AGAGTACTTGACCAAGAACTTGACCAAGAATGCACAAGCCAATAGATCAAAACCACAACGGGATGTCTGCAAGGTCGAT<br>CGTCACTGATTGTCGAGCTTTATCTGTATCTGACGGGATTATCCTGATGACAACATTATCACGATGCCGAAGACGATGCCTC<br>CAAAGACCAACCATCATCGACGGAATTATCCCGTGATGACAACATTTGCAAAACCACCGTGACAGCACCG<br>ATGATGACGAGCACTCCACCACCGTTGTGGAACACGGGCGCCAACCACCATCACAACTTGAAAGCGCGATTGTT<br>GAAAACCATCCCTGAGATATCCCAGACAATGCTGGACAATGCTCCAGACAACATCAGGTGAAGCATGATCATCCAGTTGA<br>GTGTAATCTCTTCTTGAGATTGTTTGAATTGTTCTGTCAAGCATCTCGCAAGACGTGATGGAACGTTGATGGCGTCACGGTATATCTTGA<br>AGGACGACTCGATCGATCTCGTTCGTCGTCGAAGCATCGTCAGACCGAGATTCCTTGGACCACTTTGAACTGG<br>TACTTGTTGGAGATCCAGAACAATCCTGGAACAAGCGCCAAAATCAGGTGAAGACAAGGCATCATCGACTGAGTTGGCTAAAG<br>CCGTGCGAGGATGCAAAACCTAAGGACAGAATATTCGGTGATGACTAACGGGAGATTCATCGACCTAAGCCTAATAA<br>CTTGAGCACTCTTTTGGAGGTTATGGTTATTTCGATAGGCGATGGAGACACTCAAGGACACCAATCTC | |

TABLE 19-continued

| Gene (Organism) | Nucleic acid sequence of the gene protein-encoding sequence (from START codon to STOP codon except where otherwise noted) | SEQ ID NO |
|---|---|---|
| | CAGAACCTCCGTTCTTGCATCGTGCTGGATCCCGGTTTCAGCATTCGTGAAATAGGCAAGAAGTTGAGATTAAGC GAGTATCCTAAGTTGTAG | |
| CRC1 (Candida viswanathii ATCC 20336) | atggacgacgtgattctgcttagccgcgataatgttaaatcctcgcgcgtggttttggtggtattgtgcgtgttgacggtcatcatcgactggtcaaggtcaga ttgcaaactggttgtacaaatcgtcagtgcaatgtcaaagaaacaatagccaaagacgggttgttttggtgtatacagaagacgggttgttgcttgctccattgtggggtgtcac cccaatgtttgcgttcctttcggggtctgacagcgttggtacgacgttgccgctccattcgaaagagtccaagtcatgatgcagatcagaagctgaatcagtcgacaagttgacaagttcgacactgccggtttc catccagtgccatccaaccacctggttgcgctccatcaacaaagcatgtagtccaagtccatggtgccgttgtg ctgaaatgcaaccggtgatcaggacaactcaagctgactagctcaaagtctgccccaggttccaaggttcgctgtatttcgtactactataatgggtca agaggaattgactgcctggtgaagctgcctgaagtccacggcaagtgcagggaagtggtgtcccaattgacaactcaagt ctacccagcagttccaacgctgtacttccctagggggttgaattggcagaagtcttggcaaagtatataa agagcttccccagccaagctgtaccttccctagggggttgaattggccagaagtcttggcaaagtatataa | 71 |
| ACH1 (Candida viswanathii ATCC 20336) | atgtctgccatttgaacaaaagagtagatgctccatacctcaaaaattgagaacagcagaacaatgtctgacttgtcaagacggcaatactggttggt cggtttcaccgtgctgggtgccaaggctgtgccccaaaggctgtcccagcgctttgttgaccactggagtccaactgactggttcgtgcatgacaaatggcctccaatgtttcaactttgttgtcagggaccacctgttcgactgctggg tgccggtgcagaagaaagagatgggctgaaacaacaatcaagtcgcccatcaagttatctagatctccacactaagtcggtaagccaatcgtctgtgctgcatcaatgaaagtccacactaagcc ctcagttctcgacagcctttgccatgtccaataagcaagaattgacctagacctgcccaaccggtgaaccgttatcgactcatcattgaagcacctgttgaactcttggtctccaacaggtgaaatctgact tacgccacactgaatatctgacttcccagaagcctctccagatagccactttgtgaccaccctgcattgcaaccctattgaagtctctccactcgcaacaaatga | 72 |
| Engineered DNA ACH1Δmts-pts | atggctccataccttccaaaaattgagaacagcagaacaatgtctgacttgtcaagaacggcaatactggttgtcggtttcaccggtcggtgccccaa ggctgtcccagccgcttgttgaccacgtgaaagacaacggcaggccaattgctgctgccaccatcaaggctt ccactgttgctgttctctcgccggtcgtcagaagcacttgtcgatgt ggctgaaacaacatggtctttatctcagaccctctacaccaagaacaaccggctcccaaatggctgctcgccaattagtctcttgcgacacacttgtcgatgt tcccacaagattgacctgacttcctacaccaagaaacggctccaaatggctccaactggattccacatcatcgaagctacccgccataacaggatggtgccat tatccgagtcctagcctgaaaatgtttcggtttcgcaacacattgctttcggctgtttcgcaatcccctaccatcttccaaggctcgaagatcagtgacatt gactgccagtcaacaccaccattcagacaaaccccaaaggttcaactcagcagccaatgctatcctcaaaggtgcagcacacccttcagacttcgaaccctgaccag cattgtgaaaaccacaagggtgacaacagcaaggttcagcaaacttgcaaacgcttggaggcgggctacccgttcaagtgaaatacg cacaaatacttcaagggccatttatcctcgaagttgtgatacgcacaaggtctcctcagaacctgcagcagccaagatggccctcttctcttgcagcagccaccccagcagccagccaagccagccagccattgc aaacaagtcgtctcccagaaaacttgcacccattacaccccatcccaaggttcaccatcactcaggacaccctgcggttgctcagcagcacgcagcagccaagccagcagccaagcagcagctaccatcactcaggggatcc gtctaccgagcagcttcgcagccaacgcgttcacgcaccaggttgatctgaccaccactagcaagaaagaaagtatatcaccgactcagccaggcctccaattgc agactatctgatcgaccagcgtttgacgttcccagggtacgtttgacgttccctatttgtcgcagaacggcggccagccctagctacaacgattcgatgt gtaccatgaagtcgaacaaagtagagacaaaaagaaggcagccgaatg | 73 |
| ACC1 (Candida viswanathii ATCC 20336) contained in pAA1910 | atgacagatcttcccaagtcaacagctccttaattacaccaagtcactcatccttgccatcacatttcttaggtggaactcgggctgctccaccgtgagcttct gccggacagattcgtcaaaacaccaaggtcacactgtatcaccaaggcttgatcgcaacaactcccgaagatggcgcgcaagaaataagatcgtcagaa aatgggctacgaaactttggtgacgaagcctgcaattacagttgctacagtccccggaaatgcgagaccgatgccgacgtgtccaaggttgggg tcatgctccgaaaacccttgttgccagragttgaagctgccatgtgactatggtttattgggttgttacagtcgcaggtgttggtaacagtcttgctggagacagccttgcaaagaacaaaagttctgccgagaaaaatatggacgat tgccggactgagcagttgccaggaaaccggagtagaggttgccaagatagtctgcatggccctgcatgagcctgctggtatgcacagcatgctccagctct cttataagacatcttcggttccaacgccatcgcaccatgttgcaccctctctggtgtcatccatttcttaggtggaactcgggctgctgcaccgtgctgcgtgagccttct | 74 |

TABLE 19-continued

TABLE 19-continued

| Gene (Organism) | Nucleic acid sequence of the gene protein-encoding sequence (from START codon to STOP codon except where otherwise noted) | SEQ ID NO |
|---|---|---|
| | actgcgacttgtcgccagaagaacatgccaagtcagcaccaagattgcaagcgtcaaggtgaaaggcattgttgccaatctatgccaatttctgtcagttgccgactt gcacgacagatccgacgtatgatggtcaagtgtcattagaaagaaatcaagtgggttgacgccagacgttcttctctggagattgagaagaagattgaac gaagagtacgtttgaagttgatttgattggtgaagagtcaacagtcaagcttgtgaacaagttgaaaaggttccagttgaagttggatgccaactgttgactacgacgatga ccaagtcgtcagtactgattgaatgaagaaaccgccaaattgaagaagattgaagaattgagacaggaagaacaagccgacattgcaaatgtgc aagaagaccatcaaacgtgctcctgttatgaggattcgttgatagattcgtgatagatgtccgatgaagaagaagaatcctttaaatcattgaactag | |
| ACC1 (Candida viswanathii ATCC 20336) contained in pAA245 (includes 5' intron sequence) | atgagatgccaagtagtatccaaccatcacgatttcaacttgcttgtacatgactccacgaacaactacttaattatcagttgtaaatacccgtattcctagacgtca ttatccttaatttttcattcaagaacctactaaagaaaatacagatcttccccagtccacaactcctaattacaacagtcacacagttgccatcacatt tcttaggtgggaactccggtcgtcacccgctccgccgtgacagattcgtcaaaacacaaggtcacacttgtatcaccaagtcttgattgcaacacg gtattgctgccgcaaagaaataagatccgtcagaaaatggcctcagaaagtctacgtgctgcatgtcgccatgcatggcacactggaaatcatcactggtcaacttgcaagcatgggtagtggctctaatggatgatttggaagatcgaagaagacaactgtcacattcaagatgcaattagaccagtcactgcttgaatgtgcgttctttaccactgatgtctacgtcgcgatctctcgcgcaacaatctgtcgttagaagaagatcagagaacactcctgaaatgaaactgcaatgtctcctatctgattgatgctcaaccagacctcaaacctgcttttctgtgaactttgaagcatcgttgcgtcaaactgtatattctgcgtcacaagtcggaatctctaggtgcttgtactggaactcatctgcaaaaccagaactgtatacagtggtcatatgactgagatctgtgcatgtcatgcaagctgtcatatccatcagtgaaaccggaataagtgttgttagccagcagcagttcagtagatcttcaaggaatccaagattcactcgtcaactcttagtggaaagcaagtatcatcaaacctgacaatctcatcccggctgttttcgactcacaactggctccacttctctcatgaaactgttctcttagagtatcaactccacttctttcagtgcacaagcccacgtaacagcccgcaattccacggtcgccgcaacagtcaagctgttctgcatgtgaaagttgctctcgacaactttagtggctgaaatccaaggaagcatctttctctctggcgaacatgttgaggcaacttcggaacaattctgatattgcattcctctgcactggaatgatgaagaagaatatggctgtgtgggatcagtggaaggaatgtttgatcaatctggaatgttttggaagaaaatttgaatgaccaacttaatcctatgttaagatctatgacagtcttgcgacaatcgcttgtatccaaactagaatcaacatagcagatcatgctccttgccatcatgacaactctgtcgctcgcccttgaaacctacagccaatctccacggcaaccaccatcatagatcaccagcttccatcccagttgaatagatcgactggttcaagtgtccaaggtcctggtaaccatgtcggcatgtgaacacattggtctaacagttggaacgatggtgggaatatcgaacaattcgtagtcctcaatagttgccctgctccgctgaatccacaaagtggatgagccttgacgttcgagcatgttctgaggtttggcaagtcattcctcctaacctaatcaaagtggcaacgaattgctgtccactgcaggcgacaaatcaaagtggtgaagacggtgaacaagtccctcaagacatttgtgtggtgtactggtgcagaagcaggtttctgaaacgagttgatgcgtgacaatgaacctggtgcgttacggagagaccaagtgttaggaattcagacgaagaaccaagagtccgcctgttaaagaagacttcacaggtgacatcgctctgctggcatggtcaacatcccgtgaaaagtgcttccaggagaattcatgtgtcatgttaaccaactggaagtattcaacctgagaacagcttgacatcgttgtcatcaatgaggcagctggtcctcatccatgaagcaactccaggaagcatctggccccagagtgacactgaggtttgaccacatcagtctctgagtggctctcttgaactcgaccacacgactattttcgaatttgagaagatacacttgtcaagtcttgtactaccaacgaatctgacagtgagtgtcaacctagctgagcttgaagaaatgggctgtagaagtcttgcctgggaaagcacggagcagatgagccccagtgaaagttgctgttcgtcaatacattgctctccctccattcagtcccgtgtgccacaggagacaagatgattcagatgcttgtagcagtcttgtctaggttgtctttctctccaatgagagctgagtgaaagaggttcctagttgccatgggaacctagacctgtactaccatctgccctatcgattctttaccctacccctaactgcaacgtatcatctacatgcttgacgtttgtcgcactgtcagttcaaggggctctccaaagcaagttgcaggccgagacagaccatggtccgcaacgtggaaatcgaaaggcacaacagcagcctaagtgtcatgtcagagtgcagaattcaagcttccaagagacacgaggacagttcagacagatcttcatccaagaaggttcttgcggaagctgagatgcacgtcaagcaatcttgtcttacaacactgcgcccaccaagtcacttatgcttgctcattcaataacctgcagcagagagctctttacgatcaggtcccagcgagtagaagattggacaccattaaagactcatcatatcaataaccttcaggttgcgacttgctctctcaaccaagcccaaatctggccacccagcgccaatctgcaccaatctggccacccagcgaccaaccatcgctgccatgctgccgcaatcgctcggaagtcctgagcatatccacatgcggcatcgctgacgtcgcgcgtgcgcggaagtccaggctagaatctgcaggcaccggtcaagtcaaaagaaggagagaaattgtggtgcatgtggcagcagtcatgtgatccgtcaaaactatctctgcgatttccaacaaccccgcgtgaaggttgctgactgtcatcacctgcaagaacttccatcgttaactatcttcgaatgacaaagcgaagtcagcaagttcacgtgtccagttgcagttctcgcttcttgttcatagtcttgctgttgagtttagtcacgacttcgactagtagatcatcaccatttcctcgcaggaggatactactactacgctgatcaatagcgcgcacccaacatcttcagttggaattcgaagaagtcattgaagcagatcacgaaagttcgtcgttccaagtttcagcacttgcaagaagacactcaatcgattgaacacacttttcatcaactctccactgcttcgcacgttgatgctgaaactcgattgaagtgtatacagcaatcccaagagaagtgtcaacctctgtagagcgtctatgtggaagtttgtgagaatctgaaagaggatactgttgaaatcaaagaaatggatcgtcgaatgcacaatgtaagcaccatctgtcctctcatttcccagagtgtccgtcaaggcatcagagagcgtcctcttgttaaagactgtccaaggaggcagatttggtcttgttgacagaagtgcagtgcgtcatactactgtcaatcatgttgaacacttttagtggtgaagaac gcttttggcatctggagcttctgagctagagaacatttgattccatcaggccgtgcattcaactgcgtcggaagaatagatcatcagtcggatcatcggctgcagtgttgcttgcagaaacattttagagaaattgaaccaatgaacaaatggacaaagttgtcaagaagaagtgcgcaaggttacgaccactttgatgcttcagtctcagcgatcctcatcatactacgttgtattgagctcatcactgctcgtcagctcgctggctgccacaaccttaaccagagcttcctaccgaacacacagcagatatatcaagagttgctgctgcatcgttgccatatcatggtataccacctcaagccaatttgcagattgacattcgattgtcaagagctgcgtggatgatgcatccgattttactctgctcgaatctgactcagacagatctatgtttggtaagaaaatcatgatgtctgatccacgctcattttcggaaatgcaatgctcgacaattgactcagttgagcctggtgtcaatgtttctgactcctgacgactgaatcttcgcatctcactcctcccaatgaagaaggacgcaagaagcctcaaaagatgtcttcgatagaatgcgcacaattcgaaatcctgagcggaagcagcacttggggagattcgagctgctgcggaagctcctcaatcaccgcaaacttccaatagcaaagccaatttgggaattgtcgccaacactgaccatcatttgcttgtcagttggaatgaagacccctcctctgtttacgatttcacgattccccagagttccgtcaagctccgcaagcacctcccaatgaacagatggcacctccaatttccggtgagaaggatgatcatcaaggagtccttcaggcaccagtatcagatgtcttggtccaagaatgcttaactctttggagtgccagtttgcccgtggtgcgctttcgaagagatgctgcctggtgctgagcgacaaagtctacctcttggtacaaccgaagaagatgcgagtccaaaacgaagttctgaactcgagttgagaagattgcatgcgctcaatcggagcattcctcaagagagtccaggtgagcttgcaaagtgttaaaggcgaaatctctgaaagcgattgccaagctgagatcagcagctgagtctgttcaatccgagtgtgatgagacggaatctctcaccccgattgcgtgagaaagaaaactgaggagtcagtcatgtttatgccatattgcggctccactgttgagtgagttcatgttgaacgtatgctttactgcgcacaagttgttgctctgcatgtcagtcagccaggacaaggtcaaggcttggcaccatctgttccgaagcttgcatccaagcttcatgggcgaatgccgaaccaccttgcgacgtgtgctagcgttcactggactggcttcattgtggacttcgttgtaccatccgatgagtctgcatcatgggtgttgattgtgactgctacacaatcctgaagaagttgatttgttaaaggaatcttgtcaaatgttatcgtcaaaggtcttggtactgcttgacacatttcaccactcgattgaaccacatttcatcaactctccaagtttcaacgtttcaacgtgagaacttgctcttgcctatccatatcaatagcttccttaagttctgatcaactatctgacatttcttaaggatcaagcatcatttcttgaatggcatcattcaagtttacggagaattacatttgaatcaggatcaattgtgtccctcaaaatctatggtcaaagagaatcaagacgaagaggcagccactcttgttacggcaaaaaacgtacag ctcacaacatggaactctttgtttacgattccgcatccatcggtcaggtcatagcaacaagttcgaaacctgtatcaatctcttgtgttctgcagttgtgttggccttttgagtctctctcccagctccgtgatcatatcatgccatcgtgtcaatcatgtcttcatcaaggcaggctcaaaagtcttc | 75 |

TABLE 19-continued

| Gene (Organism) | Nucleic acid sequence of the gene protein-encoding sequence (from START codon to STOP codon except where otherwise noted) | SEQ ID NO |
|---|---|---|
| ACS1 (Candida viswanathii ATCC 20336) | ctgaataccaacggacgttcattcattgttgccaatgatatcaccccaagattggttcctttggtccagatgaagtgaatacttcaacaagtgtaccgacttg gccagaagttgggtgttcagaattaccttctgccaactccggtgccaagacgcgccaagattggtgtgccaagaagttgatccattgtaccaagtgcttggaacgaaaagg taaccagataaggtttcagatcttcagtacttgaactcagacgcaaagaacgttggagacggcgaagaagcttgaaaaagacacggcaagagttgacactgaacgattgcgaag atggtcaagaaacgtcacgttatcaaggccatggctccattacctggtcacttgtagatcgttgtattggtcactgcctgcactcaagagcctaca gagacattccaccattcacaagtgttggcaagagttcaggttatctgcctagatgaaggctatccgtcgtgtcgtattggtgcattggtcaaatcattttgact ggtgcaccagctatcaacaagtgttgggtagagaagttcatggaagatgtcctaccgtccagtcgtatgccagtcgtgtgtatcgatcaatctgaagtacccggtacccag tgacgattggctggtgtgaagaactcatggaagtcatggaatggtttcctaccgttaccagctcttccagtaaagtgccagctggaagggacaga cattgactactacaccaaagacaagaagcttcgacactcagatggatgacccagatgatgccaaggtgaaggttgaacaagttgttgacaaggttc attccaagaaactttatcaggatggtcaaggttcgtcgtggtcatcccaagtgatccgcagagctatatgggagaactgcaacgcacagc gatcccagctgaccacaaggctgccaactgcccactgaagctccactgaagagcgcggtcaagatctgtcaagacctgtatctgtggtcagagagatatgtcaacaactgggttcctgaagtacaacaacctgcttccaaacctggtacgagagctccaagcacatatcaagagtgttaccagagataagcccgctc cgactttcaacacgtaactttgccattgacatatgatatcttggcaactacaaggtaaagaagtctcttgggtctcagagagagtaccacgtaagat atgttcaagttcttagtgtccagcttcaatttcaacttcaaccatctccgacattcccaaatgtgacttgattgctgcctttgaaggttgatcttgaccatcccgaca tgatggaaatgtatgccgcgactgactgactcagactggtgttttggaaccagaagtatggttggtcatcagacggacaccgaccaagatgtgtgctaccatgcccaagat tgatcaacctcatgccaaatttctgcctgccaagttctgtccaaatttgccagggagtcgcacagatccgacggtatgatggcctaaaggtcattgacccaaggcat acaggagaagaaaccgacattgccaagtgccaatgtcaagttgtccaaggaagaagaccagcccatcaagaccgccaagcaggttcaaccgttgccag aaagtgcctgcccttaaatcattgaactag | 76 |
| ACS2 (Candida viswanathii ATCC 20336) | atgcccagaatcaactcaacatcctcacattctctttggaccatgaaaatgcagcaactgaaaccccaaaccatctgccagtctacagtctcaccgacgctccaactgctccaaccttcaaacctcgacttg acttgacacttacaagcactgtacaagcagtcggtaaagcagtacaagcagtcgctccaagcatcctgcctggtcatcaacgccagcgttctataaccggtgatagtgggcc atcaagacgacctgactcgtcaacagccagtctcatattcattatgaaggtgacgaacaacagaccctgtctgtactgaaatcacttcatggcgaatcactatggcgaatgtcagaatcgtcatc cagacctgaccaaagttggtcttgcctggtcagtttttctccgctcctgagagatgagtgcttctgtctgcagaatcactattttgtttcaagacttcagagaagcctctgccgag cactcggttcgttcaggagaagatgtctcagtgacgagctgcgaaatgttcgactgctgctgtcatcactacactggtgtcatcactacactgaaagaagtgtcatccagaagacgagctctgcatagagggtgaagac gatggcacctgtgactggttttcctattcctggaccagcttcctgaaggaccacaagaccctggaaggcgaattgaaccgtcagactcgtgagacactggcatcaagcaaaggtgactctaagctacagtgaaggtcaaactgaaccaaggtcaactcaacttgtggggtccaatacggcttagatttgtcaacaaatgtgccaaccatcttccatcttaagaaatccagtctcagtctctaagtatcgac ctggagattctgaccaagtcacggcctcgtgaaaccagtcacaagtgaacaatctgccggctgtaccccatggagagcggtaccagagcaagccccacacatgtccatatgctg gcaaacagaagtcgaagtcttcaaagttttctcagactcgtggaccctacccagactgttaccaaaaaggcgcatgtctacctcctccaaagatcttgaccatggccacagtttcacagaaagactagatatatcga accaccgtgaagaaatagaagtgcccatctcgtcaggtttcttcgctgccgtactccagacgtccgacctggtgaagtacctgagagacagagcaagccgcttcaagtttc cggtcacagttgactcgaagaagacctcgaagacgtcgaactgaaagcttcagagaaggtcgctctcagacgagattaccagggagtgttattgtgttactggtctgacacgtgttgactgttgttgacgtcagcctggttatgcgactcgagacttggtcatgcgagttgcgtctgcttctgacgactggttatgtctgacggcgactcggtcaagcgcgct gcctcacgcagtttctgcaagaagtgactaagtgatcttgagcccacgcagtcgatgcagtaatcggttaagatcatagcagatccaagaatcacagagatctgcagatcct aagtgtacttcttgtcccaaaccggttgtcaaagaggaactgaatgtcatccagcctgcccaaggcacaagatcaatggggtatct ccacctgtccaaccagggcgtgtccaacaaccagatcatgaactgaagtcatggtccatcgctctctacttgttcatgcctgcctgaagatccttgaagatatctgaagata | 77 |
| | atgactacagactcaaaccccacaggttgtcacggagcaatggtcaagtggtcaagtgagacaaacccaaaggaattcttccaaagcaacaaggga cactccaagacacggaagagtacaagaaattgtatgacgcaatccataaagaaccccaaggttctttggcccattgaacactgttgccagaacgcttggccaac atttccaaccaagtcaagtcagtacctgaagacgctgacctgcctggttcttacaccgaagaagcttcagactgccgagaagtgcatcagctgtgcttgcact cctggggacaagcagccatcatcacgagcagtgagcagaggatttctactaccaagaagagacaccgcttgcaagacctgcaagcccttgccaaagtgtccattggcttccattgcatgccattggcctgccaactcctgtatc ttgtctggttcctcccggttctatcaaagaacagagcaacagcgcagctttactacctgtatgaaggtagaggtgcagaaccaccaacat caagagtgtgcgacgaaggttgaagacttcaagcagttgtgaagcagttgcaagaagcggcaagttcgacacacttctgttgtacacttctggttccactggtact gaattactgggacgaagacccgcagttctccgataattcttcgccaagaacactgcacctagagaaccgcgaagaccctgacttccactgcacctgccaccaaaaataacattctttagacgaaaagttctagtgccaccagaagtcctccctgctgtgatgtcg ggtggatcactggtccaccacctcagtctctttagtgccatgtgttgtggcgttcctctgttttttccaagagaccaccagctaccacagctcccagaccaccaagaagattctgcaagtctttgcagagtacagtccg | 77 |

TABLE 19-continued

| Gene (Organism) | Nucleic acid sequence of the gene protein-encoding sequence (from START codon to STOP codon except where otherwise noted) | SEQ ID NO |
|---|---|---|
| TES1-1 (Candida viswanathii ATCC 20336) | gaaaaacaaggctaccacttctacgttgctccactgctttgagattgtgctaaagctggtgaacaagaagttggcaagtacgacttgagttcattgagaacc tgggtctgttggtgaccaatctcccagatatttgggaatgtacaagttgtcggtaaggaccaatgtcatatctggatactcactggcaaacgaatccgg tctcacttgatgctccattggctggtgcctgtgcacagtccaggttcctgcttcttaccattcttggattgaagctgcttgatgaccagtcactgtgtgaaatc aaggcaacgatgttgaaggtgcgtgttgtgtgcaaggacaacctcatgccaagaactgtttcaacaacactgtaagtactactgatacctacatgaacc ataccaggctactattcactggtgtgatgctgcagacccaaggttggtgaatccgctgttgatgtcagagtgagtgatgtcttactggatgttcttggccagattgt ccaccggcggaattgaatctgcttgtgaagacgcttgaagaccaagatggttgaatccgttggtgatcctggttatcaacgatgaccttgcaagcgttattcaagcgtttatcgtcatcttggttcaag gaaatcggcggacgtgctgaagatcatgaggaagctcagaagaagaattgaaaaatggttgaatccgatgctcaacaaatctggtgactcatcacccagg actgcctcagaagaagaagactcaagagggctgccaaaaatctgaagaagttcagttcaaccggcgatctcaacaccttcaacaaccaaggg ttctgtgaaggtgatgatttctgcctcgtgctcgaattcgtgctcaattcggtcgaagaagtaa | 78 |
| TES1-1 (Candida viswanathii ATCC 20336) | atgtcttactaacttctgtgctccaaaccctgcctgatttcgaagaagccttgaagatcgaagagctcatcaaagtggacatacacactgtgctgccattcgttgtgagattgcct gtgaaagagagcgaggcgcttcatgcttgtagcaccgttgcccagttcgccgtttgcgtgtggttatcagaagtcatcatggtcacaagagactaataagctcatcctgact cgtaccacctgtacttatgaccgtgctcgaaatccaaaatcccatgcaactataacgacgatgaaactatacgacgtcagcaagcgttcatcattgc gaacaaagggaaagcatcgttgactgttgacatttgttacattgaagcacccggtacagcccttcacagcaccggactcgtcagtcgcactcgcaccctgccc aagtccagttaaaaacacctgatccgacgacttatgcccgaacaagtgaaccggattttacgaacacaagaactcgccaacccggcttgattactagaagctgcc ggaagaaacgaattctatgcccgaaaagatttgaccagaccttgaaaccggagagacttgaccgagtccagtcagtagcgccaacgacttagccagacatctacctttgggttgtagacctg ccagaccgccagggccgatgccgacagtccacagggaattcttgcatcccatgagtcgtgctcgaaatcgtgctcgaactgcgttagagggcacaagacgcgattcacttagggtgccagtgctagcctcgctgctacgagagatgcaactgat acatcggttcccaacaggtcactcgagatgtcaatcccgatgcatggccgtacttccaccatgcagttcgtgctaccatccccgaccaagagctcgatcatatcccacatgaagatgactctcccatgatcactcccagtgcgatcgggtacttcccagttacctaatacagttgatcacctgccaacacagcgggtctctcaagcctcaggcactaat aagcttcctagggacttcctagctggagttgcacagcctgagcctcaataccttgggaaggaattcttggatcaagccttcgctccaattctcatgaaggtattccaaattcgcaagaaggtgttcaaacccggtagtctctccagaagacagtccggaatggcggtgagtttcgtagcttcgggttagaagccagacaagggcaactcggttgaaggaggtgcaatggctccgctggctccttctgaactctgccttcaacgaaatacaagcagctttaaaagacttaccttggaacgaaatgagcctaagcatccagctgataactcacatccaaataagtgggagccgaatcactcgaccggagagctcagaagacgattgcgccacctcaaattcccaacggatactgagcactcgacgcgctgtcaattcacactcatcgacttgagcctgattcaacaccaaataccagttgcca gatctgctcaagatcgccatatccgcaggaggccatgtcaaccagcgcatagcggtgacaagaagttctgagatattggttccgcaccagttgctcagcacttggcatctcctcacaccaaggcgctgactgcaaaggctgcatcttgccaacaccggctgtctcagctacaaatctgtgactcgctacgtcagttgaccacaattgtccaggaagggtcatgatgcttaacggtcttgaac aagtgctaaatttataa | |
| TES2-1 (Candida viswanathii ATCC 20336) | Atgattgagaacattcaggaaacggaaactacccacagaactggaaggagttgacttgagtgagagggaatcggagttgaaaaataggtatcaacttgtaccgtggc aagaccaatacccggaccgcaccgagagccgacagaagcgttccagagagcagaccacttccagaatgtcgaaatcctgaaactcggccaactacgccaagagccg gacacaacctgtccatcctcatctactttatcaaagctccaagttggtgctacagcagagctctggacccatgacagccagttgtcaagagcatccaacacagcagcaa cctgcaagcctccaggcttcccaagcgtaacttggtctacacacagcgctcaatacgaccgcacaatacctgagagaaagtgccgtcagcgaagtgaagcaacggtgtcaagcctt ttgagttccaggaaacaccacagtggtttgaaaacacaagaagaccaagaattgactgcgtacacgacgtgacgcagcagcagctcgacgatcaacgtccagctgttgagtgaagactgg gttgctccgtgaagtcaactcgattgcctaccggtgccaccacctttcccgtcacctactgaagctctatgtcaccgaggtgcggtactctacctaccgacgattttgagttgaagaccgtg accaacctcagtcgtctgcccaacccgctgacgcattgcaagttcgtacaccagcgtcatgcactccgatgtctacgacaaggtgtcaacctgaccaagattgatcagttgcagcttacca gatccagccacccgcatgtcaagcggctaccggtgctagtggtgccagtgaagttatactacgacaaggggtcaagtgctaaaagtgaaccagtgtccagggaaagggactctaacgcggtcgtgtcaactgtattattaa | 79 |
| TES2-2 (Candida viswanathii ATCC 20336) | Atgattgagagcattcaggaaacggaaaacggaaacacccagagggcaactcacgagaagccgagagttgacttgagtgagaaggaattcggacttggttgactggttactgcgtcgatgctatcgttgactcgtgcaggaatcggagtttcttagctgctgcaagtcttttagtgccaagaacattcgccaagaaactcccaacgcccaacgagccgcagagccagagcc tgcaagagcctgttcactcgacttggccacgcgaatactcagatcccgacttggaaagatatccgcatccttcaccacaaattctccaggagccgcacac agtccaggggaagtccacaagatcaacagcccagcgagctggaatacaagagatctgcaccgctgtattccaactgaagctatccaagagcttgtgagttcaagacgctg ccattaggcaactcgatcaatgctctggtcgtccctgaccacacccatgtgttctcctgaccagactcttgatgtcaaatgaagagctcaaggttacccaga accaaccatgtccaatacctttctgacagtgctactagaatgtcacctgcttctggccagcgctccaagttcttgaatcgacagtcactaccagactcatcaccagatccgcaagagaccagtgaagagagtt gtcacaaccgtcagttgccaaggtgaagttacaacgacaagggtacacgtgttacaaattgtccaaggactgatgctgtcaaagagcttgaagaggt gctaaattataa | 80 |
| TES3-1 (Candida viswanathii ATCC 20336) | Atgtgtcaccacgccagagaaagtcacggagtcaccaaagttgcgaaaacaaataccgtggaacaaatcgaacagcggccaaaaacac gcgagtatgcggaaaactcgtgccagccatctggtagctccgaagcagccgagaaggttcaacaactccatccaccagcaacttcattcgtggc ggcgaccgaagtccgcttgaccaagagtcgagtatccagtcgaagcgagcggaccgaagagcagtacaccgatctcaacagaccgatcagtcgagcaagtgac gtcgccacggtcgttgacaacagaactcaaccacccgcaaccggtaggctaccgacacgcgcgccccgacgagactcgcaagacgtacgcaacgcc gagtagaacactaccaggggacgtgctcctacttgaggtcaagaactgcactcgactcgactgctgcggatgtccaagtgggcgcgag aacgacgtgaaggaccgcagcgacgccagcgaccgaccactcgagcagagcttgagcttcgggtaccgtctcgccatcaacgccgcacatcgccacct | 81 |

TABLE 19-continued

| Gene (Organism) | Nucleic acid sequence of the gene protein-encoding sequence (from START codon to STOP codon except where otherwise noted) | SEQ ID NO |
|---|---|---|
| | gagcacgcccaagttcaactgtcgctcgaccacagtgtgtacttccacggcgcgacttgacgtgacgtcgacgaccacgatccgcatgacgaagct ccgcacggccgcgcgtgatgaggcgagtgtactcggaccagggcaggcacatccgcagcatagtcgaagaggtgtacatagctgagtcgccgaa gctctga | |
| TES4-1 (Candida viswanathii ATCC 20336) | atgacgctgattgcaccggtcaccgcccagacatacccgctggacatctccaccatatacgacgtcaaacagatcgaccgccaaccgctacggcgttcggcgct ccagaaacaggacgccagttccgcggagtcttggaggcaactcgttgcccagtccgtggtgctggccttggctgccaccgacatgccaggattccaaccactcc gtccacgcctactacgtgcctgccgtgacgagacgagaagaccgccaatggagtggagcgcaacacgggcctcgccaaccgctgacgcg gatgcagaacaagaaggtggttcaacgacactacgagcagatcgagcgccgccctgtgacaggaaccatccaatcgccaagtgatcaacacgctgcagtc cagcggacaaccagcagctccgacagatcgagcgagtctcgtttctggtcggttggcaactatgggggtcagcagcgtgacgatgacagcacagtaccgcggtggct ctgaagtcagctccggactggttaggctccggtcttctacttgtcgtacattttctcactttgaccaatatgggggtgcacgtcgttcgactgcgggaccatatcgtcacgcagcagcc gtgtcgctccgaaactggttctcttccgtcaagctgcgccgatgcttcaacggcgggatcttcacgacaccgtgcttcaaccagctcgaagatcccgacgggccacgttg ctagcatcagacaggggcttatatgtcgtcagcaaccgcaaagcaaaagtttag | 82 |
| TES5-1 (Candida viswanathii ATCC 20336) | atgccccacattcaactacaaggacggcgaaacaatagacgtgcagaagagtttggcgtgcagagcgcccacaagtacgtcggctggcgtgaagccactc gtcaaggccgatcctcatgtaaaggagtcttggcggtaacctcgcagcaatgctggctccatggtcggttgccgccagactttagccacactccttg cattcgtactttatacgcccgcagcagcacaccgtcagtgacttgcagcgcgatatcgatgcctctgtaactcgtaacgcaacgtgaagaatacgcaataaacaggatccaa aacgacaaggtcatatacattcgaatgtgtcgttgactacgacgaagaagatcagaatcaggaagatacaagcaggtgtacctcgtatacgtcgagacgcaggagag gacaaggacgggatctcgacaagtgccagtccgaataaatgctgaagtgggaagagtttgtgggaagttcgagggcagtatcgacagtgcttgctccgggaggaaagagtttcaacaggagaa gactgtgccagctcgagacggatcaagtggggtggcttgcgaagctcttgctacttgtgaagacgacaagagcgcattgataccgacttgacactgtactgaagagcgagctgtcactgacagtcgtca gtgtgtgttgccaatatcactcgactattccagcggatgtgatgttacttggacaagtgacaagttgatggcttacgtcgagatattcagtttcgagatatcacatatcgggttattttaaggtgag tattcagaccgtccactctattccaaggtgaggggctatgcttaaggaagacgctctagtgagaagcgctactgaaaaagccaagtgtga | 83 |
| TES6-1 (Candida viswanathii ATCC 20336) | Atgtcaaccaccgaatctacaacgccaaaccgcctgcatattgggaaacaaaaccaagtcaagttagttatctactgaaggaccgaaatgtcctgcgaa ggattgcaccccgtcgagaccataaaagaaactgtagaaaggaatctccaatatcttagtgctcaaggggtgaactgacgcagcttggaatcaatggcaacaggatg gatttcaacctccatccatttcacgcatactgcagacgcacacaaccaatagtgctcacgatcacgatgcaaaactgtcatcaagtgaattcaagagctgccaac ggatgtaaacgctaccacagcacgacaacatgcgcaaaatcagaagacatcccattgtcatcgactccactcatgtcatggttcatggaaaagttcaagttacgacattacgaaaagagattcgagtacagagctccatgtcagaatactggatgaactgacctggggttgtcacctcgagagctttgggttgcc actcgagaacaatcttcctccggccaagattattctaaacatccttcggggtgcatctcaatccgatggtgcatcttaccgatggtgtgggtatttgcttgctactagagcttggggttgaa actgagacaaagataccgacttcttgacgttgaacaccacgtatccacggcaaacttactcgactgtccgacgtagtctcttgttagattaggtttgaaa catgaagaacaagatagtcgctgcaaagtctgaaacacccatttattgtgactgctccaggcaaactgtcacacttcttacctccaaagtgtgtga aagtcgcaagaatagctgcaaaagcgaatagaagagcaggtcacaactccaagtgtag | 84 |
| TES7-1 (Candida viswanathii ATCC 20336) | atggacaaactacaagctgaagtatacaggcgaacctccccgtgccaaccagcagaattgatatcttctgatgggccaaatgac ctacgaaggagtgtaccccgtgagctgtagtcagaaatcgtcgggagaacctcagggggaaccacgggtagattcatagcacaaggaattctagcacaaagaa caataagactgactttccaaccccatatcattactgagactgcagggaatccaaatcaggggaacctcaggggaaccaaggcaggatccttccaaggcaggatcaagagcagaatt tgcaaccgtcaatgtagccgccattgtgcgttaaaataagaaatgtatccgtttcgcaataccaaccaaccaatggacgctcaccaagctcagatcagtgatcctgaataccgcacaggatgcgat tacaagcgcgccctcttagccaggcattacaagttctcctgaatccgactcgcgatcaagaaatcctgaaataccgcagctgtgatcagatactacgctgtgctcgatcatgaagaagaaccaagactggattgaacaaagt ctccatatttttcagtgaaagtggcacgcaaccgattattgatcagattactcgggagaaatcttcgtagttagccacaaccgtattccatgacgcaacttgattccatacgtaacgctgtttcactttggg agccttaggctgcaattggcaccttgaacaaggaaatcttggtgttgtgaactttccagcagctgtgtgtgtcactgtgattcaagaagatagagctgttggg attcaggttgggaagttgaaccacaacacaagatgtctaagaaagaggatcaccccgaaattatag | 85 |
| TES7-2 (Candida viswanathii | atggacaaattacaagctgaagtatacgacgtagtcagaaagatataccaggcgcgcaaattgaaaggcgcaaatgatatctgctgatgggcaaattgatc tacgaaggagtgtaccctgtgagctgtaccgacgagacgcttagggggaacctacgggaggacttcataggaacctacgggaggagttcatggttcctggagtcgattgc aataagactgacttcaaccacttcattacatgatccgttttgcaaggcaggctccgacagtcgtttactgttacgttgggaagctagtgatagcgagaagctttt | 86 |

TABLE 19-continued

| Gene (Organism) | Nucleic acid sequence of the gene protein-encoding sequence (from START codon to STOP codon except where otherwise noted) | SEQ ID NO |
|---|---|---|
| ATCC 20336 | gccaaccgtctaatgttagcatcagactcaccaccaaccaattggtcttcacgatgcagatatcgttcactaaggataacaacgaagaaattaaacgtgctgagta caagcagctatgggagtggcggtaaatagaagtatccgttgcaatcaagaaaccaccaatgaagtactcaaattgaaagacaaagtggacacc ttccatatttgaacatacaaaagtggaatatgcaactgcaaattcttggatacccctgattcttgaatacgcacagagtcacgacacgtggaacaaagagttt ggtattcatgaaaagtactagatgattactccaatggaataaaaactagagacacgcgttcttgggtgcctttgtcgcgtgtgttcagtttcacgca gcctaggttgccattggcacttggaaactcttgaaaggaaattcttcgtgttagtttagacacacatgtattccatagcgccaacttatttgattcagtagtgatcttgtgattt caggtttgtgaattgaacaacaagagagctcggagttgacaacaagcaggcttgtctgcaactttgttcaagaagcgtactgttttgcaccag gatcatagaccaatcacaagatagctgaaaagagcggcataagaagcaggtgatcaccccgaaattataq | 87 |
| TES8-1 (Candida viswanathii ATCC 20336) | Atggagagattacaggcgaagctctacgacgtctacaccaagttgctaaaccaacagttcgaaccaagactacgtcaaattagtgctcaggacggaagaggattggtt tatgaactcatttatcagttgaacatatccagtgaactatcaaagaaggattccaagaggcttatgaggtgaccctgaatgcacgggattcgcacg aagaaagattccagcctcattcagttcaaccatgaaacctttgttaagctccaacaaacaaaatcaatttgagatgaaggtcaagtcaagtgtcagaagtttgct aactgttcgtcgtggctatcaacaacaccaatggccctgcttcctcatcatgcagtccaatgcagatgctaagtgctgaatacaacaaa gttgttgaaagtggtgcaaatcagaagtattccattgtcatcagaagctccggatacttcaaatttaaggacaattcttgagatctagaacatt gagcaaccaatggcaacattgccacgccatgtcgaagattgtttgataacgcactggaagtcgaacatgaacctagtctcgaaatcaagagttgtattttcatg caggtctggataattactcggtaggagtgactacacaacttttaccttgacaatgaccaaccttcccacccgattctttccacctgattcttttgttcaagagctggggttgc catgtgagctacataacatttttggatcgatacagaaccaatccaattcgacccaagtgatctttccacttgtattgattcagtgtgttcaa tttgaaaaatgacaggcctgggcgttgctaattttacacttagagggtaagctatattccacttgattcaagaggttacctctttttacaccaggatcatgccaa gtcccaagagatagctgtcaaggtgaaacagaggcaagtcaagtctaaatgcaaagtgtaa | 88 |
| Engineered DNA TES3-1 Apis | atgagtcaccaaccgcagaagtctacgaggtcaccaaattgcaaaccaaatacgtggggaacagcctgaacaagccacgcgaaaacacg cggagtgtatggcggaaacttctgtgagtggaaagctctgcatggcatcgagtcagcagcccggaaggtcacacacactccatccaacggcaactcattcgtacg ggcacccgaagtctgttgaccaacagaactcaaccaccgaccagagcttcacgtacgacaccgacgagtccaaacgcgtcaagacgtacggcaacgcg agtagacacatatctcaaccaggctggtgcttctgaggtcaaggctgcaagaactcaacagtgctgactcgcacagactctgcctcgctcaagtggggccgaga acacgcgtgaaggaccgcagcagtgcagcccagttgctggtcggcctgcaagtgtgggcacagtctgaagacacggactggacatccactg aaccagccgcacaagttcaacgtgctcgcgacaagtgtactccacaaccaggcaggcacatgcgccagcatgctgacgaccaggtgcgacgatcgacgaagtc ggcacgccgcgggcacatacaaccaagcatcttgatatttttacacttgagggggaaaaggcttcagattattgtcctactgtcag | 89 |
| PEX11 (Candida viswanathii ATCC 20336) | Atggctcgccatctcttagtctaccaccagcttccaaattagtcaagttcttggacacaaccccaaagaggaaaaaggttcttcacattcatcagaaaggccatgagattctt gaagccaataatcaacttgcctccaaggcctccaaggcatgcaatcaaagttgtgaccaaacagcctgcagatcaccatctcagaaactttgcctacgccgc tacttgaccatcgacggtgtcatattctcaagtgttgggtctcattgacgcaagaagttccccaacttgctctacataacgcctccagatctctggttgatcgggtgattgc cgttgatcaactccaactggccgtactactccagtccggttgatcattaaccctgaagaacctgagacgaaggagagacgacctaagaagaagaccgatctatccaccagtt gtacgccgctaagaaaattggtctggactttgttgatgactatacttttgatgcatctcttgaactcctttgaacatctcttgcattcaccgagggtgacgtcgggtcgctactatca cccccctttggattgtgaagacttgtgtgaagccacttaa | 89 |
| CPRB (Candida viswanathii ATCC 20336) | atggcttttagacaagtttagattgtatcatcataacattgttgctgctggtgctgaggaataacaagttgcttgatcagcccaggaccaacggtccctca acacgaacgaagcaacaatgtcagaagactcttgctgactatgaagaagataacaaaacgtgtttgttgtccagaccggtacggcgagatt agccaacaaatgtcaagagaattgcactcaggattggcctcagagttgctgaagacatggttgcagattgcagtctgctgatagatcaccgaagtat ctgttgttttcatcgtgccactgaggtgaacctccctgaggtaactggctgagatgttgacaagttgcacaagttgacacttgagtacttgagat atacggtgacggcgactgcacctacactacgagtttcaattgatcagttcatggctggacggcactgggaagatggtacagattgtacagatgctg aagtgacgacggcaaacgtgaaattgactgagagagagtgactgtcgtgccgactccaagttcgacctgtcttcctgggtgagcaaacaagaagcatacagaaccggagttaa gtacgaaccaaagtgaatgtgacgtccattcgaccaaccccaccatggccaggatggttgcgctcgcatgtgttcagctccagaccatggcatcaactgatctacgttgaat tgacattctgaatcgaatctgaaatcaaactgtctatctattggaggcattgaacctacaacctgctgaccatccaaagttctccaagcaatttcaagtttcggtattga agataaactgacactgcattattcttttgctgatcggggcttgcctgtatttctcctgatgagaaacaaactctcatggtctactgaccttgaagaagctcc ggtcccagtctccgagacaaagttcaacattgcccagatcgaggtttgctgctgggttgctgtattctccacaacactcccatgaacctgaagtctgaagcagagatgtc aggttaccccgagaagcggcaaccaacaagagctgaaattgcaaaaagaacgatggcgaaaaacagagtcgatggcgatgggactcactggtg ttgtaccaactgtgaagaacattgaaaacattgcagaaaagccgaaaagcaactggctcactcagttgttcactcacgattgagcgccagcagcggtc | 90 |

TABLE 19-continued

| Gene (Organism) | Nucleic acid sequence of the gene protein-encoding sequence (from START codon to STOP codon except where otherwise noted) | SEQ ID NO |
|---|---|---|
| | aagttgcagtcgacgtgaagaatccaacttaagtgccaaagaactccaccacccagttatcttgattggtccaggtactggtgttgcccattgagaaggttcgt tagagaagagtcaacaagtcaagatgtgcaatgttgccaagactttgtgttttatggtgagaaactcaacgaggactttgtacaagcaagaatgggcc gagtacgcttctgtttggtgaaaacttgagatgttcaatgctcctttctagacaagaccattccagaaggttacgtccaggataagatttagaaaacagccaact tgtgcagaatgttgaccgaaggtgccattactacgctggtgacgactagaatggccagagaccatctccaagatgtgtgcaaaagca gagaaatcagtgaagacaaggccgctgaattggtcaagtcctgaaagtccaaaatagataccaagaagatgtttgtag | |
| FAA1 (Candida viswanathii ATCC 20336) | ATGGGTGCCCTTTAACAGTCGCCGTTGGCGAAGCAAAACCAGGCGAAGAAAACCGCTCCAAGAAGAAAAGCGCTC AAAAAATGCCTCTGTCGACGCCAACGACACTCAAAGGCAACACCACTTGCCAGACTTCATTGAAGAGTGTTTT GCCAGAAACGGCACCAGAGATGCCATGGCCTGAGAGACTTGGTCGAAATCCACGTCGAAATCCAAACAGGTTA CCAAATCATTGACGGCGAACAGAAAAGGTCGATAAGGACTTGATCTACTACGAAATGGGTCCTTACAACTAC AlATCCTACCCCAAGTTGTTGACGTTGGTCAAGAACTACTCCAAGGGTTGTTGGAGTTGGGCTTGGCCCCAGA TCAAGAATCCAAGTTGATGATCTTTGCCACAGTCAGACACTTCTTAGCCTCCAGTTTCCA AGGTATCCCCGTTGTCACCGACAACCAATTGTTGTCTCCTTAGTTCGTCCTTTGAGAAGGCCACCTCCGTCAA TCCGATGCCGTGTTCACGGAAATGCACCCTAACGACAAGACAGGGCGCAAAATCTACCAGGATGCGAA GTATGTCATCCACGGGAAAAGATTTTACAAATTAAGACGATATATAAATTTATTCTTTCGACGAGGTTGCCATTGGT GAACAATCCTCCAAAGAATTGCATTTCCAAAACCAGAAGACCCAATCTGTATCATGTACACCTCGGGTTCCAC CGTGCTCCAAAGGGTGTGGTTAGAACTGTCGACAGAGTGATTGCATTTTGCCATTTGGCCCACATTTTGCCTTT GAGTTTGGTTACCCTTCTGTGGGGGGCCATTGGGTTTACGCCCATGTCAAGACTTTGACCGAAGCCTCCTGCA GAAACTGTCAGCCAGACTTGAATTGAATTCAAACAACAGGCTTCTCCAATCCAACAAGATCTTCTGGCTGCATTCAATGC AGAAAGGCTGTCTTGAACCGTTATGGCTTGCCAGGCGGGTTGTTGACGTCTGCTCTTCAAGAAGGTTAAGCCG CCACTGGTGCCCATTGCGTATGCTTAATCGTGTTGATCACAAGTCTGTGCCAAGTGTTTATCTCC ACCTTGCTTGCGCCAATGTGTTGGGTACCTTGGGTTGTTGGATCTGTCACTGCCAAGTTGGTTGATGTGCTGATGCTG GCGCTTCCAGATTGTACTTTGGGTACAACCAGGGTGAAATCTGGTTGAAGACGGCAGTCCAGGTTGTCAAGGAATACTACAAGAA CGAAGAAGAAACCAAGGCTGCATTCACCGAAGATGCCTTTCACCGAAGATGCTGATTTGGTGAATGCCGCC GACGGTGGTTTGAACATCATTGACCGTAAGAACATTGGTCAAGCTGGTATATTGGTGAATGCTGTTGAA GAAATTGGAAAGTTATTTCTTTGCCCATTGAAGCCAACTTGAGTTCTATGTGAAGGAAGATTATCCCAGATGC GCCAATTGCTATTGCTTCGCCAGCTTGGTTGCACAACAAGAAGAAGGCCGAAAAGATTATCCAGATTGCT TCAAGAGATTGAGCAGCTTGGTTCACACAAGAAGGTCTCCAAGCTGCTTCGAGACACTTGCTCCAAA CCGTAAACAAGGTTTGAAAGGTATTGAATTGTTGCAGAATGTGTCTTGTTGGATGACGAGTGACCCCA CAGAATGGTTTGTTACTTCTGCCCAAAAGTTGCAGAAGAAGAGATTTTAGAAAGTTGTAAAAAGAAGTTGAA GAGGCATACAAGTCGTCTTAG | 91 |
| POX5 (Candida viswanathii ATCC 20336) | atgcctaccgaacttcaaaagaagaagaactcaccaagttcaaccaaggagttgaactacttcttgaaggttcccaagaaagatcgagatcatcagca catgtcgaacaaatgacttgaagacgcaaaagacccctatctgaaggtcgacgttcatactcaaccttgaccaaagaccaacaaagaagtcaccgccaagaagttgcc agactcccagatacttgagcacgagctgcagatcccagattgtcgatcctcggttgctcttgaccagatggcctcaccagagtcgtcaactg ggttgttgtttcctgtcgtcggtaaccaccgataccctcactgaccactaaagaggtatccagaggtgaggttgcaaggtgtatggtggtgatgactg atgtggcctgctcgcaaccaccccactatccgaccattgaaccaaaatcttgaatcaaatcaactatcatatggggagtactggggaccaactaggagagtggtatcctaggtttgctcgtccattgagag gtggatcgtggtcgtgcaacctgagtcctcgctaccgcagatgagccatttgaaggtcgcagatggtgtgcaagtcttgtcccattgagag actccaaccagccctgagtcctcgagcaaggtgcacagtttgactgtggtgaggttcagatttgcaaggtgtcgcacctctgaccatgtgtcaagctcagaatc ccaagattctttatgtcgaacagtatgcaaaagtactgcaagattcatcacagtcatcaagagtctggagataccgccaccatgtctgaagtggagtcccaccat gatgatgactcctacggaaccagtagattcttgtctcccaaggttgtccattgatctagactcggtctggagaccctagaaccaccatgaacgcaaccaa cgacaagttggacgaagctgtcagtgctgactgacaagctcgtcaagtcgccattgacgctgccattgtcaacgagaagccaatggtttttcgaatcgttccgcctgattgttgaagccactgt acctggttgactggtgaagccattgagcaagctcgaagcgtcaagttgcaagtcgtttgaaaaggaagccattgggtgtgcaagaccgtgtgtgagacttgccaagaaattgttcgcttcgcttcggtttaaagcctaccgactggttgtctcccagtg gacaagttgacgaagaccaacaactttggcaccacaagtgttcaaacacaactttggcaccaaccagtgttaagggtcagcacaccagcctggattggttctccaccgttg ccgactggaacgacccagccagtcccttccggcttgatggccaagaacatttcgaagcaaaggttttgcgactttgacattaccg | 92 |

TABLE 19-continued

| Gene (Organism) | Nucleic acid sequence of the gene protein-encoding sequence (from START codon to STOP codon except where otherwise noted) | SEQ ID NO |
|---|---|---|
| | gtccaagttggtttgttcaagttgaacgctcacagattcttgattgacggttcttcaaggtatcacccagaatgttctgaagtcttgagaccttggtttcttgtat gcgactggatcttgaccaacttggtgccacttcttgcagtagcgtcattacccagatgtcagcagaaagattcctccgacacttcccagctctgtgtgcca ggttagaacgttgtggtttgactgatgttcaacttgactgacatgatgacatgtcgctattggtagatatgtagtaacgtctgaacactgaaact gtcaaggcttgaaccaccagaaaaccacccaaggctccatactccaaggcttgaagcatgttgaacgtcagacttgaagtcagaagaggtgaaa gtccgaagagctgctgaaatcttgtccagttaa | |
| POX4 (Candida viswanathii ATCC 20336) | atgactcttacaagaaaacgtagtgtatcaaagtcctgacctgaccctagatactcatccaaaggaaagacagtccaaatgaaccctcaacaatgaac tactcctggaagctccgtcgaaagagttgactcctgcccaacaatgaaggaagaccaatcttgttcacgacgtcgctcctgacgatg caaggaccaacaaagagaattgacgccgtcaagatcgcagatacgagatcgatgtggcttccctctgcaaatccgtatcagaagtcttgaacagattgtcctgattg gtatcttgacccagtcggtaccaggatcggtcaacctcggtttctcctttgagcagtaacgtcccaatgaacactgctggtggttggaacactggctaacgaat aggaaccgtcgacgtcaagatcacgggatctcacgttgttctcggtacgacccggtccaagttgctggttcgcgcacattgaaagaat ctgagtgtcatcaacaacgcaagagtttcctgtcgtctcccatatggcaaactccaaaatgtgctactgtcgctcagattgattgac ggtcaagattacggtgtcaagactttgtttgtgtccattgagagtcaagatctcaagatccaccacgcttgagttcacatgagatggagatg gatcgtaacgtgatgtaccctgaacactcccaagtcagatcaaggacaaagtctgtaaggtctcgtgaagtcgccttgccaccttgga acaatgcttcactctgtgtgaaagattgatgcatgtccccacatgagacgtgctagaagtgtccaatacctccaaatgttccctactctcgtgcc ccaagtgtccctgctggtgtccctcaagttgccccaaggtgaagacaccacactcctgaagtgaattggacgtcgcgctgaagccattgtttgggctgacaacatgtcctgaagcattgacaatgttggcatgtgtaacgtcaacatgcccactcccaagtgttcaacgt attgacgacatgaagtcattgtttgtgtactgaaaagcctcaacagtggggttgtcctcaataagtgtgtcaacaatgtgttgcctactactgccaagtcca acctgctaacgctgaagaccttgatgacagaccctgccatagctactctctggacagattgatacatacaatctgaagaagctccaggttgttttaa gaacgttatcagcatcacactcggtctgctgaatgtccggagtccggaagacaagtttgaaggcttcaacttcgatggcatcttaaggtctggccat gctgcttgctgctggactgacacgtcaagctcaactccaagttcaaggttgccggttcaactccgacgtgaaagcgtggtcgtaaagtagagaga tgtcggggctgaattggtcaactgcagactgcgactgacatctcggagtgagaaagaattgattgccccatagcgcctctgtgatggtgacat ctatgagaactactcgagcaggggttgtctaacttgtgttgttgaaccagatgcctagtctatccgatgaccgagagaaaagcgaggt aagactacgtgttaatacagagactgagagccagaagctgcgagatcagaagatgctaatcaaatttatcctcagaaagaccagtgccatattgctg atatagatgacgatgaacatgcgatcacgtccagtgccatggagcacgcagctaacagatgttcagggagatcgaaacatgaaacctgactgtgt gttggttgccgacttttgagtcaagtagttgaaagaagcacgtgtagtctcagacagttgcgatacaccggcaggtagtgttcagtattactgcca ccatgatcctaaattgcactactccgatcatgttgccagcagtcgatactcacggactatcactgacgatgttggcaaacgttcggcaaaacttctgtcca gctcggaattctctctcccacgggtctggcccggtcggtctagagctgtaggctactgtcttacccacagaagtgcttcaccaccggaagttgcgtgaccaagt ggttaccctaatagcgaatagagtgtcttggcctttaatccatcatgcgtatcaaaccaatggtagatcaagtttaaatgcgtacagaagttgaaccagaactgg attgcaaaacattggtagagagaaaacgaaagattagtgtgttaacaagatgttgttaacgacaagtattgtcattcttgattgacgtcgggcgtgccc cagatatgaagttgatgtacgaggttgcaaatgaacgcgttgcaaggtcaaagcaattacgatgtcaagatccatatttgttaaacctctcatacatcattaa | 94 |
| PXA1 (Candida viswanathii ATCC 20336) | | |
| PXA2 | atgacagtggagaatgcaaaactacagaagaactcgttggcgttctgtcttcttgaagtgtacaatccaacagatcattattgttaaacacctcatacatcattaa | 95 |

TABLE 19-continued

| Gene (Organism) | Nucleic acid sequence of the gene protein-encoding sequence (from START codon to STOP codon except where otherwise noted) | SEQ ID NO |
|---|---|---|
| ACL1 (*Candida viswanathii* ATCC 20336) | tcattgctgcttcactggcgcaacgataccggcgaggcacctcctccagatcatcggcaaagtagagaccgatgagaacaatcggttaaaagaaaca cccaagctctctagagagtccttcctagatcaagaaaagcaattctgccaacttcttgatagaaccatagttactttcgccaactgactttgttggtgtcagag cattattgacacttagagtgtccaaattgcctttgaccggtcagttgttggggcattggttcaagaatgtttgccaagtactgttgtactgatgttcttggtatcc ccgtcgcttgacaaatgcctttgactgaccaactgaactggttcaagagcattgaactgaatgcaatatacaccatggaggaaacttgcagataact tggacccaaactattattcattgatcatttgactgataacaagattagagacccaagttaaagcaagcgggttgtggaatgggaagctggcattccaagattgttgcc gccggtcacatattgaagccaacgttggatcatcatatgtgcgcaacagtagagcgggtttcagtcgcgcattccaagattgtttggtatatggc aacttgaagaaatgtgcttcttgggagtccaagatccgtgatttgcaacacgcgaatcctactacttgaaggcgaatattgaaggcgag cataacgaatcaccaaccaagttatgtgaagtactttgggttgttgtgtctgaccggtttagtgtctcgaccgctttcattgccaaaagataacttgttgcaagtcgtcgtcatgct aagaatgtgctggtaattcatcaccacaaacgaagattgtgatgatgcgccggatccttggaaagagaaacacctgaatgtcagttcgagataacgacgagattacttcgatcatgt agattgatgatcttctggacacttacatgaacttgaatcctgaactttccattaacacagctgacttcgttgggcaacgttcagtaagtgctgtt gttcagaatgttggtggttggcccgtaagttgtggccccgtagttgtggtactattagaaaacagaaagataacagattgctccaacgtgtctatggggcaaaaggctacttcgttgaaggatcattc agagagcaaatcatttatccaacaaagtgatcaacaacagaaagatgatcaacaaagattggctgcatatggctagtgcataatactgaagttactaccggcaat tggatggtggttaagaactggaagaaatgtccattggctcaacaagcacgaactggtctatcgttcttacgatggtactgctagatggtcacacgaatg tactcgctgttcaccagacgcatgaacaactcgtccaccaacaagccagccaacaagttggtatcgcgacacagccattgtgcactccaca aatacttgttgaattcgacggagaagtgtactacttgtgatcgtatcctccaagaagtcgcacggagactgacctag | 96 |
| ACL2 (*Yarrowia lipolytica* CLIB122) codon optimized for Candida strain ATCC 20336 | atgtccgccaacgaaacatctccagattcgacgttcggttccgggtaaggaacccagctcacgaatattccataccacaagatccttcgtttatgattaca acctgagcctgtcaaggaaactgttgaacttgtgactcgactcgtttaccgttaccaacaagtgaagagaaaaccctcgcgccggagttcaatcgtcgtcaagatgt actgggtaccaaggaaacctcttttactgttaccgaatacccaatcagaccatcagctcgcagacccaagttcatgttcgttaacttgcctcgagatctgttt atcttccaccatggaattgttagaataccccaccaatgtccgttgcaagccaggatgttcaaggtgggcaacaccggaatgacaacattgtgcc aaagagaggaccacccatcatttgaggaccatttcaaggctgccaaggtcaaccatgtcaactgcggatgtggcatgtccaacatctccccaccaccgacgagtctagcaaggaa tctaagtgtatacagaccagttcgtgcctacgttgcctaagctgaacctgcttgatagcaccaagagcgaagatctcccattgaccaagatcatcgtttactgagaagtggag ttgctggaagaaatatcagagtttcgctccatcgaatagggtgaggttgccaaaaatgagtgccaagggtgaaatgtccgaaatcccaatgaactttgatcctcgaattggt gagtctatcgactgcaggttatctgacagcatcaaacaagatcaagaggttagaatctccaccccaaagaccgtggattcggtgaattgttcagagatacttcactgtcccat atgccagagttctgccaattatcagaaagcagctctgttgtggacaccagagctcttgtgacgagaagctaagttttcctcttggctggatctattggaacagacacgcctctccaagctgttcaaggaa gcgtattggagccgcacaattcaccatacgactcagactacgcctcaagttcctcttgggtggtgatattattgacccatggaacattgagaaagaactccatccaccaatgttagactactacgcctcgttga tgaccgggcagagctggagctcgactgtcctcgtactgcaccgacatgagggagtcggaaggattaattcctcttggctgggatgccaaaaccagttgatttcctgaattggt catgagtaagtccagacgaaaaccaaaccagatttcagagttgaactgtgaacgtggacggagcactggcgtgctccttgttgatttaatgaccacccatttgatattaatgaccctgagcgttgaagaaactccaccacattagatcaaaagagatagaacgaccttactgtgaagaaact aagaataaggcctcgcaagctcaagatcaccacaaggcaacttgataattgaaacgggattggtgcctcgtgtcgttgaggaggaagatgtgaaatgcagacggagaagtaa gaagatactttaagaaacgaggatcacctactctggtgggttgggtgttcgtgttcaagaatcaattgtcaaatcagtgccgttgacgtgtctaaggccagactagcatga g | 97 |
| ACL2 (*Yarrowia lipolytica* CLIB122) codon optimized for Candida strain ATCC 20336 | atgtcagcgaatctattcacgaagcgcgacggtagcagccttgttagcacacacttttgctaagacacacttttgtaagcacactttctgttgccgacttgagat gggtaccaagttggctcgtcctgacgttcgcaagggtaaggcgtgtcgaagatcttcccgccgtccgagaagaccaccatggttgttgaatctgtgcca agttgtgccagccaatcaactcgaagtattgacgggcttgaggaaacgtcgtctgtggttgaccgccatttaaacaagtcgtgggaaatgtaagcatgatcgacgtgc cgccaagccaatcaagctcgaagtcttgagaaacgttgtagacgctgacgtcgacgcaagcgcgcaagctcatcgttagagttcatcatcaccggtttactgct ctgcaggaggcgactggatcttatctaccagaaggtgtgacgttggacagaagatctccatcctatagtgagaagaccgccgcaagatttgtagctagaccaccaccaaa cgaataccatcaaggcacgcacgtggcacactttctgcagacccgtgatgcagcgttcacactgtgtgttgaaagtttcgatacactgtcgcggtaagcgccggtcattcatggt tgattgcaattactgggttggaaatcaacactctgtgcgccccaccccaagtggtcatccccagcgtgaagatggtatcactaagccacaagcaggtgttaaccaacacccagac atttgatgtggtccaagtgggctgctgctttgggtgctcaccactgccagcatgcaagccaagacagttcgggctcctaccattgaagttgacgtgtaatgccaa gtttccccagctcgccgtatagatttgcgagaggcaaacacgacacggaacggccgtttgccgactgtccagccaaggtcacccagggaatctgatgat gtagaaattggaccctgcgatcggatcaaagaaacgaaccagctttactcgaagtcccaaccacagaagcgggaattagcgaccatggcgaaggt gctccaacgaaccaaacctccatgaccctatgattagatcatcagaaaccgtggctggcacccaggagtaaagaaggtaggattgttcattgtgccgca | 97 |

333 334

TABLE 19-continued

| Gene (Organism) | Nucleic acid sequence of the gene protein-encoding sequence (from START codon to STOP codon except where otherwise noted) | SEQ ID NO |
|---|---|---|
| | tgccaacttcaccaagtgggctctacctcaaggtatccgtgccttccgtgactaccaatctccttgcaactctcttgaccaatccaaggtcaagattacgtcagaagag gtggacaaactggcaagaaggattgctctcatcaagtcggctggtgacgattgaattgccaatgaaattaccggtccagacatgccagacgcacgtctcgggaattgtg ccctcgctttgctttgcaagcgtccaaagaagttaagccttttggtaccggccctccactgaagcttctactccttaggcgtgtaa | 98 |
| FAT1 (Candida viswanathii ATCC 20336) | ATGTCAGGATTAGAAATAGCCCCTGCTGCCATCCTTGCTGCCATCCTTCTGGTAGTAGTCAGTTATTGAAGCCAAATATTAATTGCCGA CGACGTGCTGTTAGCCAAGACAGTCGCTGTCAATGCCCTCCATACTTGTGAAAGCCAGCAGAGGTAAGGCA TCATACTGGTACTTTTCGAGCAGTCCGTGTTCAAGAACCCAAACACCAAACAAAGCGTTGGCGTTCCAAGACCAAG AAAGAATGCCCCCCAAGACGACGCCGGGATTCCAATCTACGACATCAGTTTGACCTAGAAGAA TACACCTACAAGGAATTGTACGACATGGTTTTGAAGTACTATATACATTCGAAGAACCAGAGTACGGCGTCACTGC CAACGACACCATCGGTGTTTCTTGAACTTCAACACCAAGACAAGCCATTGATCCACTGTCTTAAGATTGTCAACGCTTC TGCCTTGCCGTCGTTGACCCGAACTTGATTCCCAATCAGAATACCGAGGCTCAGATCAGAGAGGAATTGCCA GCAAGTTTTCGTTGACCGAATAAACTACATTGACGAGTTGCCTTGTTTGACAGATTGAGACTCAAGTCGACTCCAAACACAGA GCCGAGGACAAGACCAGAAGCCAGATACTGACTCCTCCGCTTGTGCATTGATTTACACCTCGGTACCA CCGGTTGCCAAAAGCCGGTATCATGTCCTGGAGAAAAGCCTTCATGGCCTCGTTTCTTTGGCCACATCATG AAGATTGACTCGAAATCGAAACGTCTTGACGCCCTTGACCCCCCATGTCCGCCATGTTGGGGTTGT GTCCTACTTTGATTGTCCGTGGCTTGTCCGTGTCCAGAGAAATTCTCCGTCTTCCGGTTCTTTGGCCATCATG AGATTATGTGGTGCCACCCACGTGCAATACGTCGGTAACGGTTGCGTCCAGATATATGGTCTGAGTTCAAGC GCAGATTCCACATTGAAGGTATCGGTGAGTCTTACGCCGCCGAGTCCCTTATCGCCACCAACTTGCA GTACGGTGAGTACGGTGTCGGCCCTCGTCGTAAGTACGGGTCCATCAGCTTTGTTATTGTCTACCAGAG AAATTGGCCAAGATGGACCCAGAGACGAGAGTGAATCTACAAGGAGACCCCAAGACGCGGTTCTGTATGTCTCCAAGA CCGCTTACAACGAGCCAGGTGAGTTGTTGATGAGAATCTTCACCAATGTTTTCAAAAAGGTGACGCGTGGTACA GATCGGTGACTTGTTGAAGATGACGAGGACAAATTGTTGTACTTTGTCGACAGATTAGGTGACACTTTCCGT TGGAAGTCCGAAAACGTCTCCGCCACCGAGGTCGAGAACGAATTGATGGGCTCCAAGCCTTGAAGCAGTC GTCGTTTCGGTGGAAGAAATCTTGAATGCTGAAATTGATTCACTCTCACGCAGGTCTTTGCCTGTGATGCTCAACCTGCGT TCATCAAGTTGGCACCATTGGCGCCGAAGATTGATTCTACTCCGTTGAATGGCGACAAGTACCAGAGTTGACTGAAGACG ATTGGTCTTTGATTTGTACCGGTAAAGCCAAATTGTAG | |
| CYP52A17 (Candida viswanathii ATCC 20336) FROM pAA1712 | atgattgaacaactcctagaattggtatgtgttgccagtgttgtacatcatcaaacaactcctgtacatcatcaaagactcgctcttgatgaaaaagttgggtgct gctccagtcacaaacaagtgtacgacaacccagtgcttcggtatcgtcaatgtctcaagaaggagcaggctcaagatcaagaacgattac aagtttgaccacctccaagaaccccagtggaccactccttcttcggcaccactgcttaggcctttgatggatcttcaactaggtggacagcagcca tgttgagaccaagttgccaagaacacactccttaagccttgtgattgtggatctccagtcacgagtccgagtcagagcagagcacaggccttgat atccaggaattgtcttcttagattaccggtcagcggccacgagttcttggcggccacaaaccagtgagtccgtagtactccagtctcctaaaggacgaatctattggtatcaaccaagggtgt atttgtgtgaaaggacttgctgtgagtcgttcaccaagctgcagctctcggaaatacctggtcgcagagaaccactgtgaaagcaagtgggtatgttcttgtac gagctgccaagctggtgcaaggcccccatgttgctgcaagttcaaacagttggacagagattggcggaaattgaacaacagttggtcttcaaggaaactcgtgttgaagagattacctgagagcttgaa ggagatgagtgactcgtaaagcgttccttaatgaaaactgctattaccaaaggggaagtgtcgtatgttggggtcgtactgtcgtaccgtgttttggtcgcagtttgccttgacg gttcagacagagcggtacctcgccaatctgatccaaaaggatactcaaccaaaagttcggctgtgtggctactgtcccaaagatgagtgttaccgggcctgtcttgcctgctga gaagctggctgtttgttagttggtcaagagtttcccacgttaggctaggcctagcaacacgaggttaccggccaaagaggttgacctctatggccagcagttgacccagtttgc aggatggtgctattgtcaagttttgactag | 99 |
| ADH1-2 alcohol | Atgtctctaatatcccaaaaactcaaaaagtcgtgtcttcgagaagaacgtggtggtaatttaaaatacaaagacatcccagtgccaaccccaaaggccaacga atgtctcatcaactcaagtaccggggtcgctgcacgatcgcacgccggatgtggcaattggacaaccaaaatgccattggtggttggttggtcacgaaggt | 100 |

TABLE 19-continued

| Gene (Organism) | Nucleic acid sequence of the gene protein-encoding sequence (from START codon to STOP codon except where otherwise noted) | SEQ ID NO |
|---|---|---|
| dehydrogenase (Candida viswanathii ATCC 20336) | gctggtgttgtcggcagtggtgaaaacgtcaaggctgagctgattcgccggtcagcccagctgatcctgaacggttcgagctgtcagcaa<br>ggtgctgaaccaaactggtgaagctgactgctgctgttgtcggtgctgctcaacatacgcgacttgatgctgcgaagcgccagaatccagct<br>ggcactgatttgccgaagttgccccaatcttgtgtcgtgtccaccgtctcacaagcctgaacctgtggtcaatgccgactatgctgcctgtcc<br>ggtggtcgttgggctcctggctgccaatacgccgcatgggtcgcctgctgtcgagtcgctgccatgatgcgcgtccacacgtgatcaatgttccgaaaagcc<br>gaagcctacaatgatttcctcaaggaaaagggccatttgggtaaggttgttcgtcaagaagcatggttggtttccagcgccacctggtgtttcgaagcgtgtcagtcaattga<br>aatgaccaatctgtcgagtgactacgtcggtaacagaagaaggatactgccgaagcgtgacttttctccagggcttgatcaagtcccaatcaagattgtggcgttgagttgaattgc<br>caccaggtcttcaagttgagtgaagaaggtaagatcttggtagtacctccaaa | 101 |
| FAO1 fatty alcohol oxidase (Candida viswanathii ATCC 20336) | atggctccattttgcccgaccagtcgactacaaacgtcgacaccctatgttatatgtgacggatcatccgacgaaccaccgtcgaccactcaaagacgtt<br>atgctcctgaatctccctgctgacaagtacgaagagtacgtcaggacatcaccaaaccctcgaaaccccaaggtttcagggaaaccgtctacaacacagtcaac<br>gcaaacaccacggaccgaatccacagtctcattattcttgaccacattgaccaccagggctcgtgactttgacgcctatcaaggacatga<br>gcttggaagaccgtgaaaaatgttggctctggcgcggactccagtctgtcaatctctgcaagttgtttctcaagcttcacgctcacgtcacgag<br>attggcaatggagttgcattgaaagcgattcacttgcagataatgataagggactcgtggtccgcgttcggtcggccaacgatgcttca<br>aagtttgtttgaaagggcaaatacttagcaactccgagtcaactttgcagaattataccaaagtgaggtacttgactacagt<br>caaccacagtgttgttcttctgctgtccacctttggtggggtaccactctgcacaagcacaatggagctcaaggcagatcaacaaagttggcagcaaatggaagtgctaaggtcgtatgatgagat<br>tttggttgacttgctgctgatgaagcatacgaaaagccaaggtattagaccacagccaaggctgtcatccctcagcacaggcggttctgtcatgcaaggcattacacagtcaac<br>ggttcaagcaggttcgtttaataactgttagagacgcgcagctgccccgcaagttgtgcgtcatgcaaactacttagagtttgcaaataactaacagaagggatc<br>gcttacgatctcgtgtggagaccatcgtaaccgcggccaagttcaacttgcaccatcagttctcgcgctcgtgatttcggcaaaagacgtaagcgagacagcacttcacactcca<br>ctccggttcaagaacaagaacatcgtaagagccgctgatttagacgcaagcgctgatgcaaggccatggcaaggcatcttgaacgtccattcatcatccaggctcatctcttgctcatccaacca<br>tcatgatgtaacgaggcagacgagactttgttcgtgaaacgagacatctttagcacaaacatgtggcatgtccctagcggcaaggatggtctgcacactgttggcactgtattaccatgg<br>aagggtagtaacgtaaggcatgaagtgcagagactaggatgaaacatcttgccaggagatgttggctgcactgtagtcttggatcaaggtgtatatcaaggtgcaagga<br>aacctgaagcttgttgtgcgacgcgcaagcttgtggcacttgcagacaaactcatctgctgactgttgtactctgactgagcttgtgtatccaaggtgtcaaggtgcc<br>atccttagtccaaggcatggtgccaattttgaatccgacaaagccaaaggtaagctcttgcctgcatgtcttcgcatgttgcaaccctatggtcaaccatatgcctgacaccgatggtaga<br>aagattcctttgacacctacggctccacctacgtccgatgcaagtcttttgccaagtcaagtcttcaccacaacactgctttatgttgccgatgcaaggccaaccctatgtgcaaccctatgtgacaccgatggtaga<br>tgtttgaatgttcgaatgttttatgtgccgatgcaagtcttttgccaagtcaagtcttcaccacaacactgctttatgttgccgatgcaaggccaaccctatgtgcaaccctatgtgacaccgatggtaga<br>gcagaccccttgaagacccaagtccaagtgtag | |
| FAS1 fatty acid synthase (Candida viswanathii ATCC 20336) | ATGTCTACTCTACTATAGACCTTTCCAATTGACCCACGGTTCCATGCAACCACACCTTGTTGTGCCAAACGAGTTGTTC<br>TTCAACTATTCACAGTTAAAAGACGAATTCATAAAGACCTTGCCTGACCACCGAAGGTTTCGCTGCGACCA<br>TGAACCTTCCAGTCCTGCTGAATTCTCGGCTACATCGTCCACAACACCGTTCAATTCCCC<br>AGATCTTACAATTGTCCTTGCAAGACTTCTGCAGCAACAATCAGCCCAACGAGGATTCTTGGACAACAACAGCAAGCACATCCACTCCTTTGCC<br>GTCAGATTATTAGAAGATGAAGCTCATCGACAAGGTCGAGTCACACTGGTTCAAAGTCAAAGAACAATATCATCAAGAACTACTAC<br>AAAGCCATCAAGTCCATCGACAAGGTCCAGTCACATTCGACACTCTGTACCACTGCAAACATGACCCAAGTTGGCCG<br>CTATATTCGGTCCGTCAAGGTAACACCACGACTACTTTGAAGAATTGCGACCAAGTTGGACCAGTTATAACCCTTTGACAAGATCTACACC<br>TTGATTGAGGACCCCTCTTATCCATTGCCGACAAGTTGGACCAGAGTTATACCCTTTTGACAAGATCTACACC<br>CAGGGTTTGAACATCTTGGGCTTGGTTGAAGCACCCAGAACACACACCCTGACCAAGATTACTTGTTGCCGTACC<br>AGTCAGTTGTCCTGTATCTGTAATCATCCAAATTGTGTCACTACACCACTCCCAAAGTTGTTCTTTGGTTTGACCC<br>TGGTGAATTAGAGACTCGTTGAGACTGGTCACTCCAAGGTTTGTACCGTCTACTGCTACGCTATTTCCA<br>GTTCCGACTCCTGGGACTTTCCTCCAAGAACACTCCGCCACCAAGAACACTTCGCTCCTCCTTTGATGCTTCACCAAATGCTGCCAGAT<br>GTTTTGAATTGGCCTTACCCAATGTGTCAGTTGCAGAACATCTTGCCACCAACATGCTCAAGACTCCTTGCAAGACCTCGGAAGGTAGA<br>TTGCCAAGGAAAAGCACATTGCCGTCAGTTTGCCAGTCTCTCCAAGTTGCTCCAAGAATTTGGTTGCTTCTTGTCCCCGA<br>GTCCCTTTAGCCGTGAAGTTCACTTGAACTTGAACTTCCAACAGATTCTTGCCAATTTGTCTCAACATCACTCACTCTTGGCTG<br>TCAGTGAACGTAAGTTGAAGTTTGGATGATGTCAAAGAGACAAGACACCGTTTTCTTTCCGAAAATTGCAGTTCAGTCTACG<br>ATACCACTACGACGCTCCAACTTCCAAGAGACAAAGACCAATTATTGACAGAACTCGTCAAGTTGATCACCGAG<br>TTGCCAGTTCACTGGGAAACCGCCACCAACCACGGGCCCACCAATTTGGATTCGGATCGTCCAGGTGCTG | 102 |

TABLE 19-continued

| Gene (Organism) | Nucleic acid sequence of the gene protein-encoding sequence (from START codon to STOP codon except where otherwise noted) | SEQ ID NO |
|---|---|---|

TABLE 19-continued

| Gene (Organism) | Nucleic acid sequence of the gene protein-encoding sequence (from START codon to STOP codon except where otherwise noted) | SEQ ID NO |
|---|---|---|
| | GAAGACGGTTCTTTGAAGTCCGAAAAGATCTTCAAGGACATTGACGAGAAAACACCACTTCCTACACCTTTGTTTCT GACACTGGGTTGTTCTGCTAAGTGACAATGCAAGTGGCATCATGTTGACTTGATGGAGAAGGCTGCCTACGACGA TATCAAGTCTAAAGGATTGATTCCAAGTGACATCATGTTGCTGTCACTCTTCTTGGTGAATATCTCTGCTTTGAC TTCCTTGGCCAACGTTATGCCTATTGAATCCTTGGTTGATGTTGTCTTCACAGAGGTATGACATGCAAGTTGC TGTTCCAAGAGACGAGTTTGGTAGATACAGATTTGTTGTGACGAGACTGCCAAGAGAACCACTGGTTGTTGAAATGTCAAC TTGACGATGCCGCCATGAGATTTGTTGTTGACAGAGATTGCTGCTGGTGACTTGAGAGCCTTGGATAACCTTGACCAACGTGTTGAA TGTTTTGAAGATCAACAAGATACGTTCTGCTCCAAGTCCATTGCTAAGCCACAACCAATTGAATTAGAAGAGGTTTTG CTGTTATCCCATTGAAGGATTCCATCTCTGTCCTGCCAAGTCCATTGCCAAGTCTTCCATTGAGGATTGTCTGGTGTCAAGCCATCCTAAT GATTCTGTGCAAGAGATTGAACTACTAGGAATACTTCCAGGATGCTACGACTTGACTAAATCGAAAAGATCAAGG CTATCTTGGACAACTGGGAAAATACGAATAG | |
| FAS2 fatty acid synthase (Candida viswanathii ATCC 20336) | ATGAAGCCAGAGATTGAACAAGAATTATTCCACACCTTGTTAACAGAATTGTTAGCTTACAGTTCGCTTCCTCCA GTCAGATGGATCGAACCAAGATTGTCCTTCTTGAAGCAACACACACGCGAAAGAATCATCGACACCCCAGCTGCCCCCTTC CCAACCTTGGCCCGTATGGCTTATGCTACCTCTAAGACGGCCAAGAGACGATCTACTACAGCCAGATCAGATCTTGCTCC AAAGGAAGAACCAAAGAAGAAGGCTGCCGCCGCTCCAGCCGCCTCAGCCGTCTGCTGCTGC TACTCCTGCTGCTGCCCCAGTCGCCGCTCGCCGCTCGCCATCTGCCCTGCCTGCTGAATCCATCCCCAGATGAA CCAGTCAAGGCTTCTCCTGTTGATCACGTCTTGGTGCTAAGAACGGTAAGCGAATTCTTGGTGACTGGGTAAGA TCCAAGGCTATCACTCCAAGATTTAGTTAACGGTAAGCTCCACTGTCCAGAACGAAATTCTTGGTGACTGGGTAAAGA ATTGGTTCCACTCCTGAAAAACAGAAGATACCCATTGGAAGAAGAATTGGCCGAACAGTTCCAAGATCCTTCA GTGTCAATTGGGTAAGACTCTTGCAGTGCACTTGAACTCAAGGACAACTGCTAAGATCTTCTAAGATGCCTGGTGTTTCTCAA TCACCGCTGCCAGAAAATTAACTTGGAATCAGATTCGGTTGGGGTTCTGAGGCCGAAGCTAAGAACAAGACTCTCGTTGGT GCTTTGACCAACGAACCTGCAAGCAGATTGGGTTCTGAGGCCGAAGCTAAGACCTTCTTGGACCACCATGGCTC AGAAATATGCCTCATCTGCTGGTATTCCTTGCTCCACTGGTATTCTCGCAGTTCCGTGCCGGTCTCCGGTGGAGTGCCGCGG TGGCGCCGTTGTTGACACGTCTCGTGCTCTTGACGGCTTGACTCTGAAAACAAGGAAATTGGCTAGAACAAAT TAG AGGTCTGCAATGGGTAAGATACTGCAGTGCAGTTGAACTCAAGGACACTAAGTCTTTATCAAGAAAAGAAGCTTC GCTGTTTTTGCAGAAAAGATTGGACTTGTGGAAGCCGAACATGGTGAATTCTACGCCAGAGGTATCAAACCAAC TTTCTCAGCTTTGAAAGGCAAGAACCTATGATCATTGACTTGAATTCGGTTGACCTACTGGAACTGGGCCAGACAAGATGTTTGTCCATGTACTT TGATATTTGTTTGGTAAGTTGACCTCCGTTGACAGAGAAAACCATCGACCAAGTGTATCCAAATTATGAACAGAT CAACCAACTTGATCAAGTTCATCAGCAATACACATTGCCCAACAATACAGAGTCCACTGCCCAGTCAAGTTACAGT TGGCCAAGAGATTGGGTCAACAGTTGATTGACAACCACGTCGCCAAGGGTACACGTGAATCAGTGTACAAGGAC GTTTCTGAATCACTGGTCCAAAAGACACTACGTCTACCAAATGGCCCAAGGTACAGTGTGAAATGCCAAGATTGCCCAACCA ACTATCGTAAGAAGTTGGACTTACCAAGCCATCTCCAAGCAGTTCCAGACACACACGAAGTTGAATTGCCCAACCA ACTATCCTTACAGACTCTACCAAGCAATTGTTGAAGGTGTCCAACCCAACTGAGAAGATAAATTTCCACCGCCGACTCTGACGAT GAAATTGCAAGCTGCAACTCCAGACAAGACAGTTCAATTGCCCAACCAGTTTCTTCAACCCGCCCCAGCACATTCCA TTCTTGCACATCTCAAAAAGAAGACCCAACAAGGACCACCCAAGTCTGCCTTTTACTTGACCGGAC CCAATTGGAAATCCGCTGCTGTCAAGGTTGAAATGGGATGCAACATTCCCAGATGGTGCCAAGTGTTTGGTGTCTGGAT CATGTGTGCGAAATCTTGAAGTTTGTCAAGCCTCAACACTGTTGCTGCAATGCTCTAGAAATGAAGGAAAGCTTGGTT TTTAAACAAGGTTCTAAACAACATGTGACCATTATCCCTTCTGACCCTCAATGCTCTGTTCTAACCACGATCCAAAAGAGAAGGTGGTTT AGGTCTGGGAACTTCGGAAATCAACTAGCCCCAGAAATTGCTTGTTGACCTTGGACCACGATCCAAGATTGATT CTAAATCCGAATTCCCTTATTGGTTGAACCAAGCTGTATCTGTGTGTGCTGCTCAACATTGGCCGCCAACAACATCATT CTACCGACCAGACCAGCCTCATTATCCCTCATTCGTGATTCCTGACAGATGTCTACCAAGCTCTTGGGAAGGTGTTT GAATCCAAAGTTCCACTAGTTTCCTTTGGAAGCACCGGCACACTGTCCGAAGATTTGGGCTCCAACGTTGAC CGTCTCGTGTGCCTTATTGGTTTGGACTGACCCAGAGAGTACTGCTTGATGAGCGCCAACAACATCATTCCAGCACGTCCAAGGT | 103 |

TABLE 19-continued

| Gene (Organism) | Nucleic acid sequence of the gene protein-encoding sequence (from START codon to STOP codon except where otherwise noted) | SEQ ID NO |
|---|---|---|
| | ATCGAAAAGATTGGTGTCAGAACCTTCTCCCAAAGAGAAATGCTTTCAACATCTTGGGTTTGTTGACTCCAGA GATTGTCAAGTTGTGCCAAGAAGAACCAGTTATGGCCGACTTATGGCCGACTTGAACGTGGTTTGCAATTCATTGAAAACTTGA AGGATTTCACTTCCAAGTTGAGATTGAGATCTGAATGCCTGAAGTTAGAAGACGTGTCTCCATTGAATCC GCCATCGAACAAAAGGTTGTCAATGGTGACAATGTTGCCAACTACACCAAGGTTACCGTTCAACCAAGAGC CAACATGAAATTCGACTTCCCAACCTTGAAATCGTACGATGAGATCAAGAAGGTTGCTCCAGAATTGGAAGGCA TGTTGGACTTGGAATCCGTCGTTGTTGTCACCGGTTTGCCGAAGTTGGTCATGGGGTAACGCCAGAACCAG ATGGGAAATGGAATCCAAGGGTGAATTCCTTGGAAGGTGCCATTGAAATGCCTGATCATGGGTTTCATCA AGTACCAACGGTAACTTGAAGGTAAGCCTTACTCTGGTTTGGGTTGCATGGCCAAGACCCAAACTCCAATCGAT GACAAGGACATCCAAGGCCAAGTACGAAGAAGAGAAGACAGATGATCATCCAAGAAGTTGGACCATTGAGCCAGAATT GTCAATGGCTACGATCCAAGAGAAACTGCTGAACAATACAAACGAACACGTGAGATCTTTGAAATTGAAGAA TCCGGAATACACGTTAGAAATCTGGAACTTTCCAAAGGCTTTGAGATTTGACAGATTG GTTGCTGTCAAATTCCAACTGGTTGGGATGCTCGTACCTACGGTATTCCAGAAGATACCATTAACCAAGTTGA TCCTATCACTTTGTACGTTCTGTTGTCTGTCCGAAGCTTTGTTGTCTGCTGGTATCACCGACCCATATGAATT CTACAAGTACGTCCACGTTCCACAGTTGGTAACTGTTCGGTTCCGGATGGGTGTCTCGCCTTGAGAG GAATGTTCAAGGACAGAATACGCCGCAAGTGCAAAAGATATCTTCAAGAATCTTTCATCAACACCATG TCCCCCTGGGTTAACATGTTGTTGTCTCTTCGGGTCCAATCAAGACCCCAGTTGGTGCCTGTCTACCGC TGTTGAATCCGTTGACATTGGATATTGGATTAACTATTTTGTCTCGGTAAGGCTAAGGTTGTTATGGTGGTTACGA TGACTTCCAGGAAGAAGGTTCTTATGAATTCGCCAACATGAATGCCCACTTCCAACTCCCTTGACGAGTTGCTC ACGGCAGAACTCCAAAGGAGATGTCCAGACCAACTACCACCAGCCAGAGACGTTTCATGGAGGCCAAGGTTC TGGTATCCAAGTTATTATGACTGCTGACAAGAATGGTAGATCTTCCAGTCCGACAAGCTTGGACAATGAATTGAAGGCTAGATT CTGCTACTGCTACCGACAAGATTGAAGTACCCATCTCCAGCTTTGAACATCAAGTACAGAAGAGACAATGAAGGCTAGATT CACCACCGTAACTTGGAGAACCATGCGAAATGCCAAATTGCTAATTGCTTACTTGCACAGAAGAGACAATGAAGGCTAGATT AGACCAAATACCAAGGCTGGACAAATTGCTGAAATTCTGAAGGAAAGAACTGAAGAACATTTGCCAAGGAAGAA ATGGGCGATGAGTTCTCATGCACAAGAATTCTTGAAGGAAACAATTCTACAAGTCTGACCCAAGAATTGCTCATTGAGAGGTG CCTTGGCTGCTTTCAACTTGACCATTGACGATCTTGGTTGCTTCCTTCCACGGTACTTCTACCGTCGCCAAC GATAAGAACGAATCCCACTATTAAGCCATGATGCAACATGATGGCAGATTGGGCAGATTCTGAAGGTAACCCAGTGTTTGG TGTTTTCCAGAAGTACTTGAGATCATCCAAGGGTGCTGCTGGTCTCATTGACAAGGTGCATCCAGA TCTTGGAGTCGTGTATTGTTCCAGGTAACAGAATGCCGATAACGTTGACAAGGTCTTCGAAGAATACGAGTAC GTCTGTACCCATCCAGATCCATCCAAACTGACGTATCAAGCCGTTCCGTGACCTCTTTCGGTTTCGGTCA AAAAGGTGCTCAAGACTGTTTGTCGTTCCACCCAGACTACTTGTTTGCGATAGATCTACTTATGAGGACTA CGCCACCAGTTTCTGCCAGAAAACAAGACTTACCGTTCACAGCTATTACTACTAGAAACACCTATGTT TGTTGCTAAGGATAAGGCTCCATATGCCGATATAAGCTCCATGAACAAGATCCAAAGAGTATCAACAAGCTTATGCTGGTGAAATGCC AAAACGTAAGGAAAAGCTTGCCTTGAACAAGCTTTGGCCAAGTTGTGGTGTCGAACGTTGAATTATTGTC AGAGCCACTGCCAAGGCTTTGAGATTGAGAATACTTTTGTTGCAGAATCAATCACTCCTCTGGTGAAATCTGCTCCAAGAG TGCCAACCCACAAGCTTCATACACCGGCACTTGGTTGACATTGAGATCACCCCTGTGGAAAGCGCTCTTCTTCAAGGCATTAGGTGTTGAAT CTAAAGGTGCTGTGCCAGCTTGGGTCGCCAAATCAGCCGCCAAAGTGGTGTCAAGAAGGTGTCAAGAACGTTCAAGATTTCCATCTCCATGACGAC TTCCACACTGCTGTTGCCTTGACGTCGAGTTCCTGTTGCCTTGTCCTTGAGTCAATTCTAG | |
| HPD1 3-hydroxy-propionate-dehydrogenase (Candida viswanathi ATCC 20336) | Atgttgagatcttcagtcctgcagctcttccacccagtccagagtatttagccaactacggttcgtaggcttcgtaggctgcacatggccagacacgtctacaa ccagttgcagccagcagcaagttgtatgtccacgagctcacgaccaccccagcacaacccagtcgtcaccgacgtgcacccagttgcaccatggagcgccgttg tctccgagctagtcgaccactacaatgcgtcgggaaatacgaccatccaagaagtgaccttgtgacctctccaccatgtccttggactcccacctccaggaggt ccaccagctcgttgccgacaagtggccgacctaacctcgtcacgcttgaactacatggcagcaacatctcccatgtggtggaacccacggaccgggcttgcgtgcca gggacaccaaggaaagacgtcgacctaacctcgtcacgcttgaactacatggcagcaacatctcccatgtggtggaacccacggaccgggcttgcatgtggctgcca agtggcaaacaactactcgtcgggactctggtcctggggtcgagcaagctccagttggcagaactcgttcagaactgcgagaactgcgaagtggtgt cgacctccaaggtaagtcctgggactagtgtcgatcaactgccccaatcccgggtctaccccgtgaaaagaacttgacttgtgataacggataacaggtgtca | 104 |

TABLE 19-continued

| Gene (Organism) | Nucleic acid sequence of the gene protein-encoding sequence (from START codon to STOP codon except where otherwise noted) | SEQ ID NO |
|---|---|---|
| | cgaagtgacgagaaaggatgtcgtcttggctacgagtctgctaaggctacaaccagttccttatgttggcgaagtcgtagtactgtacgcaaggcttgtg aagtgaaaagtacgccaacagagacttgctgtctgttcgaattctgggtgatcttaaaaataa | |
| ALD6 malonate semialdehyde dehydrogenase (Candida viswanathii ATCC 20336) | atgtatccagagtctctttcaagactaaaccagagtcctactaatcaatcaccgccatggccatcagaacaatccatcgtgacttttatcctccaccctccac ataccaaccgaccaacacgaccctgtgtctccaagcgagccatacatcacgccatcctcgtgaacaacgagttcatcaagtctggactccaacactggactcagacgtgca cgacccggccagcaactacgtcgtccaaagtgcccaagtgaccgccgacgccgagaggcgatcgcgtcgcccagctcctgaagcctttgaacgttct gacaccagcatcatcaagcgcaggggtcgtcaagtgttgtgcagtgacagaatcgcaagcgtcatgtcttgaacaggtaag cgttgtgcagcccagggtgagtgactgagctaagaaccttggtgtgctgtggatcatgattattgtaattgcgcgcaaggccgatgttgaagtctactgatat ggagaccaagatgattagaaaccttggtgttgtgggacaagtatgatatttgtaattgcgcgcaaggtgttcaacctgttgttgcttggtgttgtcacggtaagca gtgtgattaagcctccgagagtccggcgacccaagagtgattgaggccccaagatcaagggcatgagctttttgtgggtgacaaggtcagttgggca aagagtgccaactgtgctcagaaccactgcagttgcaagacccaagctttgccaatgcgtcatgtgcttcggtgctgctg gacagagtcatgctaattctcttggtcacccgtagaagacaagccaaggaatgggtgcaggatcatcgctgaagaaatcattcctggcaaacggtcaacgtgtcaacccggatt gaccaagagtgacactggatcggtcaatcaaccagagcgcagcgaaccgtgcccgagtaacctcttcatgctgccaacaagccaagctgagacgcagg attttcgctcctcgtctcggtgtcgctgtgcttagcaagagatcgcaagaacgttgctgttgttgtaataacaagtgcgatttcattattacttcctccggtgc tcagccagtattcaccaagaatcacgtcggtcgaagccgtatccaccttctgaccaagccaaagccatcactgtccttcactgttcagggctcctctggg tgacttgaacttctaccgtaaggccggtatccaccttcttgaccaagccaagcgcagaccaacctgttcgctgttgacgagatcttgaaccatc tacctcgatgctgctgccaacagtaa | 105 |
| ECI1 enoyl-CoA isomerase (Candida viswanathii ATCC 20336) | Atgccgacgaggaatcagatatcttatcgaggtcagagacagaacgcccatcacttgaactcccaagagattgaacgcattgaacgctgtcaatact tgaagttggggtaagttcttggagagcaacaagaagaggacaccgtctgacattgatccaggcgtcagccgtgacagttctctccgtgcaacttcgccgac aacgatatggccaagtcgaagttctcagtcacgagctactggttcagtcatcgcaagagactcgcgcacaagagatcttcctcgctgatcaacatcactgttcaacgaccaa gaagattcgtgctgtgtcgtcgtcaatggtcagtatgcgttcagttgaccgtgttgttgctgcacttgtcaactgaacaagttcatctgtgcccca tttgccaactggtttgttgccgaaggttgcttcctctgccactttgtcaacagatggggtggcagggccgcaagcttgcaaggcctgttgtgtgccaagcaatcggcgcc aagactgtacaacgccggtctacaagctcaacaagcaataagtgtgaagttgttcctccactgaagagttcaacgaacgtctcaagagtgacggaagtcttgaa aactgacgatgactccattttgcagaaccaggcaatttgcagagaaccaggccatcaactag | 106 |
| ECI2 enoyl-CoA isomerase (Candida viswanathii ATCC 20336) | Atgccgacgacctattccacctacgagtcaagtcaagaccgagctgccgtatccgtgatcacctgaacatccaagaagctcaacgcctatcgatccgcagtacgacc atctgcaagctcttagaacgagcaacgccgaagagaccaaccgccagtcctcagtccagagagatcttggcgagactcctcggcacaagatccctgccgtcctt gtgggcaggagccctgatggctactcctcgggcgtcggttgctcgcaagacatgtggcgcttcgctgtcacgggcagacggcgggaagaacgcggtcaacgctcactcctttctcctgtcagcagatgggcgccagggccgcaagctgtctcgggaggtacaaggaacatcggggaagatttcggagtgactcg gatccttgccgaagatgtgtcttcaattccagaacaagagtttgtgaagcctattcaagtcgcgcgggacagttttaacaatcagtgaagcaatcacgggaggatgctgg cagagagcgggttctcatcatccagatcccagaacaagagtgtgaaccattcaagcaaatcagcagcagcaagtttttgtctcgcagctgcaaacctacaagggcgggccatcccaccactcctctactatggtgatgttt catgaggactccatccagagcccaatcctgagcaccactcatcatcatatggggaacctcatacaaaccatatcatcaccaagaaccaaggctaagtggaa cactctgggtgccaatggatagatttaaaaaattgcttaatggtgagttgaacataataag | 107 |
| DCR1 dienoyl-CoA reductase (Candida viswanathii ATCC 20336) | atgccaacacacttagatcacactgtcgaagcataaacaagaaagtgtctgtgaagcgtcgaagtcatctttccgccgacaagctcatccactgtcgttaccaccaacagtgtgttccgtgtgt gcaagcgaagccatggctcttggtgctaatgctgccatcatcgtagaaaagcagtcgagggagcgaaagagctcttcggaaaaagatcggaccagga gccaagtgccatgggtatgtgcccgtgacgtgctagatccaacacttgtcgccaacacctgcaagctgcattgtgttgttgcagactacaatcaaggtttgaccc gtgccgcacggcgtctgatgtcgtaagatgcctccaacctctcatgagccttgatgttggcaagctgcctacaaccggctgcaagctggttgtgcctgta agtgaagaagaacaaaagtgccgtgagacccgagaaggcgtgtgcatcagtgatcttgcagggctatcaactgaccgtaatgaatctgcttgcaagacctcactaccagcag caagcgccgtgtctgtgaatggtgcattgagatccattccagaggacgaagcttgcacactgttgttctgctcgctatctgaactgcagctctcaactatggtgatgtttgt gtgatgtgctatgtgctatggcaaactgggcaaactgggcggtttattctttaaacgacttcttaacgactccaccccagaagtaagttgtaa | 108 |
| DCR2 dienoyl-CoA reductase (Candida viswanathii ATCC 20336) | atgccaaacacttaactgaagcataacaaacagaaagtcttgaaggccagattgttcaaggcaagcagattgctctttcatcaccgcagttcaggtcgatcgtccgt gcccagccgaaggctccatggtcttgtgggtgcccaactgccatcatgatctggagaaactgcgaaaagaccgaataccgcccaaagaatcgccagctgagatca ggaggcaaggtcttgttgattggcattggttggcaaggtgctcaaccactgtcacaaagttgacgagcccgataaagaccgtgcgaattgggcagataacgacttgtcattg ctggtgccggtaacctccttgtgacttcaaccactgtctcaaccgcctcaatcccattgactgttcggttttcttcaaccgtaagctgcaagatgcactttttga | 109 |

TABLE 19-continued

| Gene (Organism) | Nucleic acid sequence of the gene protein-encoding sequence (from START codon to STOP codon except where otherwise noted) | SEQ ID NO |
|---|---|---|
| ATCC 20336 | ccaattgagaaagaacaagggtgccatcttgtttgtcagtgcacctgcactactacggttccttccaaattgtgttggtgctgccaaggctggtgtcgacgctt gagcaatgccctgccttgagtgggtccattggcatcagatcgactgattgcccagtccaatcgacgtaccgaaggtgttgaagattggtcagagcttc caaggcgcaagccgccaagaaggttccattgcaaagattgggactacaacagacattgctactacggctctgtttctcccagcgcctccttgtcactgg tgacgtttggttgatggtgtcagctggcagatccctcggtggttcgaccaactaccccagtctccatcctccaatgcgatccgatccgaaggtgggtaagt tgtaa | |
| MCR malonyl-CoA reductase (Sulfolobus islandicus) | atgaggagaactcttaaggccgccatttgggatgactgatggtgtggtatcgaattgttagaatgtttagaacgctactaaagtgggttacctagcgg gtaagggctcagtcgcaagcctacgaagaagtgtcagatgcaaacgtcgcaagttcaagaaatcgctatatggaagcaagcctaccgatcc aagtgatgatggacgacgtcgacattatctttcgcgttgccccaagggctgtggtctgttgaagaggaattgccaaacatgatttcctgtcattccaactctcctg atcacagattcgaccagtgcccctctcctcccagaatcaatccgcttattgacaaacaaggaaaggcatgactgagggggttcatc gttaccactccttgtgcaccgcacggtgctgccattcttggcccatcctcatcatgaattcagaaatcgactccagtcatcattccaatcgctctggccgc tgggtatccaggatccccatcattagacgttgtcgacaacagtccttgccattatgacaacaaaaacagtaaagagatttccagattttgtccgagaca aagaggtgtgaacgatgacaacgatctatcgttggcgcactacggggaatcattccagatttctaacctttgaccaaccaag cgttccgtcgaaagatagaagatcacttgacaggtgggccgtagaactcattagagtgcaaaccccagaagtccagcactgtacctacgggaactagcggag ccggtcgttcataatcaaccctgcaggggagctgctgttggctggaatcttggccgctggagaactacctgtagaagagtacaattgacaagaggtaa | 323 |
| 2PS 2-pyrone synthase (Gerbera hybrida) | atgggatcctactcaagtcgacgatctattcgtgaagtcggagcggacgagcggacaagtgcgccaacattggcactgtactcctccgaattgtgt tcaagtgactgactgcggattatccgtgttactaagtctgactgacatgtggctgtactactactgcaaaaaaccggcaataagaaac ggtactagcctgacagagaggccggttaagcagtggccattgacgagtggactggatacaacagatgccaagttcatctcaagcttcagggcgttcca atgtttaggcaaagagcccggttaaggccatgaagaagaggcaagcgagcctctcaagccctctctctctctacagcgcctgtgacgttgatgactg gtgctgattatcaattgttaaatgttaattaggttagctttgagtcttcaagtaacgtgctggatgaaccccacttgattgaacccggatagagcggggac attgagaacaacaaggctcacggtcccggctgcggtgatgcggtgcttcaacggtctatcctcctctggcgtcatcatggacggatcacacttcgacaca ctctcttggaggatgaagctccactaagaggagaggtctcaggcgtatactacgatgccataagctcagccgctatgatggtcggaagaactaagcggcaga aaaagcacttcccactaggaatacctgactggataactgttgatgatcgtccaccagtgttcggccatactcagtcgaacctgcaagcctcggccgcaga aggaggcacagtcaggctggcttcaggcatgtctttagcgaactgtctaacgcatgtggaaacccacatctgctgcgtcctttatcattgatgaagcaggaaaaaag ggaagagagcacgagcgaggtcggagggtctggctggtgtctttcgatgactggttacgtctcgcttcggtgactgctgcag tgcaattggaaactaa | 325 |

Example 27: Nucleic Acid Sequences of Plasmids and Other Nucleic Acids Referenced Herein

TABLE 20

| Plasmid | Nucleic acid sequence | SEQ ID NO |
|---|---|---|
| pAA073 | aaacgcagcaacgcggccttttacggttcctgccttttgctgctgcctttgctgctgcctatccctgattctgtggtaatccgcgattaccgccttgagt gagctgataaccgctccgcgcagccgaccgagctgagcgaagcggagcgagtccgatcatcatcctgcaggagctccaa ttgtaatattcgggaaaatatcgttggggtaaaacagagagagaggagagcagtgttcgtggtagaattaatcggttgtgtgcaaatgctactgact ctgcaatgctcgtagctcgtgatgtatgcaactaggtgtatgcaactacttggagtgttcgtggtagaattaatcggttgtgtgcaaatgctactgact ctgcccccccgcgaaagataataccaaaattaacacttgtgaatttgcaccaacggattaacattcccttttgccacgatacaacgttcgtgcctctcttttttctctgtgct tccccccgtcgactgttccaccattgccacatggaataatcaactccctaaaatctcccttaaaatcttcaaaatgcaaaaaaagcaaatctcctcttttcctcttcgttatattattta ccatccctttttgaattgatctcattatgatatattcattatgaaagtagtcatatatgtaaaatgcaaatttcgttgtgtcgcttcgaactccgaacacaaaactagcc gcaaatttgattcataagtatattattccattatgatgaatagtagtaatggttaagtcccactaacattgtcaaacatttcgagtcgctcttcgagtaagagtc cggaaaaacctagttgatagtgtcgaattcggtcgacattaggctgaccatatggccacatgaccgatcctggtggtgacatctggtgttacagaac atcagtcttgaacagagtgacagtacaaacagatggtaattttcccaatttgaagaaagttctatgaaagtggtca accagagctaacagagaagcaacagagaagtgaaacagaaggtaaacaagaaggtaatgtcatcaacccaagattcccaacgttt ttatcaataaattgccatactagtcacgtagagatctcatccattcccaagaaaaaacacacagaaaggcatagcacagcatcagcatcagcaagttgcccactctgct cccatccatcatcgtcatcaaaccccagtcaattcgcaatcgcatgtagcacaaacatacacagaaagggcatagcagcacgcatcccctcgttcctgtcgtggatttcct attcgttaatgagtccaaaaagcacaatcaactctgccgatcgactggggccagcaccacacatgggcatcgcatcaatctgcagggaatcagggacagga cgtgaagacgcacatcgatctcgatctcagatcactcgcgcgaacaagggcgtctgctgagccgtgctgctgctgcctgcttgaactgcacaacacgatgctctatatcggagacagga agttgctgatcggaaaacccgtatgtgtcagtacacctcggggtatacctgggacgatctgttgagtgagtttgcagtcgtcattgaggcagtcaggaagga ggcgtcgttgaaggttgaaacgcggtgcggaggggtgaaaagggaaagggctcgtgatgttcgatggaagtagtgcattcagatgcatctggctttgattggatc atcatgacgcctggtgggtggattgatataaaaggcgtcgttgggcagcagtataggcgtggcgcagtgtggtctgactgtaaccatgtgtcgga gaggtgttcggaaagaagaccctaaggtgaggaaggtaaaagagatacaaggtgctgagagacttgaagagaactggtcagtagaataat atggttaataaataggctatatacaagctataactaagttcggacctcattgtggagctcctagttctcgatttcgaaaaccaataacgcaattgcca gtagcaggatggtggttagtcgttcctgaatggaaaaccagatacggccccttctcatcgccatcctgaagtatatcggacaatttagtattataaaggtttttgatatatatatta gaagcggatgaatacacctttgcctgaagacctgacacggcgaaaagccctcatttttatatggtccctataaaaatgatatagtttttcttcgcgcgcatcttgatcttt gacgtcaggtgcacttttcggggaaatgtgcgcggaaccctatttgtttatttttctaaatatgtattagagactgacagaaacgtttcaccagtgagacgcta aataatgtgcagtttgattcttagatccacgagggcacgcacgcaaagttgctggtatacctttagcgcgaatcaccacagtatcttcaccagtgagacgcta aaaagatggctgaaaagccctaccgtatcgaagactggggtcaaagatgggggcaccatcattaggtatccgcatcagacatgggctgctc gaccactcaacagagagctccctggcactcaacagactcaacgtcagcagcctgcctcaaacatggctggggaatccgcgagctttcgcgtactgctgc aaacaaaaaaaccccgctatcgcctaccgtacaccaggagggcttcacgagactcaacaagactaccaacgtcgcctaataccccgctcgtaatcgtcgctgc tgtctctcagtgtaccggttgactcaagacctcaacgactgatctaagagtgcgaccacccactcttagcaccgatcctcgtcgaccagcgtcgcagtggatgtaa gtcgtggttgctaccggttgactaccccagacgatagtaccgagctatgagagacggtcgcggcgaacaccgtcgtgcaacagcagctcggagcgaacga ctacacgagaccgataccgtagagctgagctatgagagacgatcgagctatgagaaggcgcacacgtatcggcattcggaagctaagcagggtcga gaggagcgcacacccgatgctgtgctagcaatggacaacatcacgcatcgctccggttgcgaactcagctacctactctcccgcgaacaattaatagactggatg gaggaggttaaaatggccctaacctcgcgcgaaccggggtccctcgtcagcggataaaatctgtgagaccggggctccggtagtcggcggtatcaggcag cactgggccaatggcctaagcccctcgcgtatctgcatcgcactcaccactatattactacactcgtgactccgaaccgagagggcgtgagataggtgcct cactgattaagcaattgtaactgtcagacaaagttacttctctgagttttgccatctgtcaccactggttaaataatcttttttgccgtaaacaatgaaaatggccctttggaatcctc atgaccaaaaatcccttaacgtgagttttcgttccactgactgactcgctgcgctcgctccaagctacctttcgaagaccgtagaaggcagtggtgtgggagcg gataaagcgcagcgcgggtgaaccgtcgcctagctgctctatcaaagcggctaagcgctcaatcccgatgtagaagctagcgctgctatccccggccctactc aacaaaaaaaaccaccgctaccagcgctggctgtctcgaaggcttgtccggactctttttttgagatcccctttttgaaagatccttttttcgcgtatcgctctgc tgtctctcagtgtaccggttgactcgctgcagcccaactctctgcctctagcagccccactccttataccgtaaccttcgcaacacagccagcttggagccgaataa gtcgtggttgctaccggttgactccccaacttgctggcactcccagccagcttcgctaccggttgcgccccgtgaactcagccaccccaaatacagccaccaaaatac gtcgtggttgctaccggttgactcaagacctaagaccgtgattagcgcctacaaaggcgcaccacctcgtcaatcgccgctactcctgctcagcgtcgtgtggcgaataa cctacacgagaccgataccgtagagctgctagtcgagctatgagaaggcgcacacgtatcggcattcggaagctaagcagggtcga gaggagcgacactgaatgttctgagcgtaacctcaagcaggcgcaggtctcgctatgacaggtatcggacaggtatcggcaagcaaggcgcag ggggccgagcgagctctatggaa | 110 |
| pAA298 | ccgtagaaagatcaaaggatctcttcttgagatcctttttttctgcgcgtaatcgtcctgcttgcaaaacaaaaaaaccaccgctaccagcggtggtttgttgccggatca agagctaccaactcttttttccggaaggtaactggcttcagcagagcgcagataccaaatactgtccttctagtgtagccgtagttaggccaccacttcaagaactctgta gcaccgcctacatacctcgctctgctaatcctgttaccagtggctgctgccagtggcgataagtcgtgtcttaccgggttggactcaagacgatagttaccggataagg cgcagcggtcgggctgaacggggggttcgtgcacacagcccagcttggagcgaacgacctacaccgaactgagatacctacagcgtgagctatgagaaagcg ccacgcttcccgaagggagaaaggcggacaggtatccggtaagcggcagggtcggaacaggagagcgcacgagggagcttccagggggaaacgcctggta tctttatagtcctgtcgggtttcgccacctctgacttgagcgtcgatttttgtgatgctcgtcaggggggcggagcctatggaaaaacgccagcaacgcggcctttttacg ggggccgagctatggaa | 111 |

TABLE 20-continued

| Plasmid | Nucleic acid sequence | SEQ ID NO |
|---|---|---|
| | gtcctgggctttgtctggcttgtctcacatgttcttcctgcgtcttccctgattctgtggataaccgtattaccgcctttgagtgagctgatgctgccgcagccga | |
| | acgaccgagcgcagcgagtcagtgagcgaggaagcggaagacgctaccgccaaccgcttcccccgcgttggcgatcatgtaatgcagctgcac | |
| | gacaggttccgactgaaagcgggcagtcagatcacaacagaaaccagagcttcactcattaggcaccccaggctttacactttatgcttccggctcgtatgt | |
| | tgtgtggaattgtgagcggataacaattcacacaggaaacagctatgaccatgattacggccaagcttaggtgacactatagaataactcaagctatcatcaagc | |
| | ttggtaccgactcgatccgcaaaatgtcacctagtaacggccgccagtgtgctggaattcgccttacggtacaaatcagcttagttcactgaaaaagtcta | |
| | cagtagtcacattctcccaaaatagtgaaatccagtcctacaacttggcttcagttgtcttaggtcttaggaaccttgtgtgaagcctcaatcttgtccaattcaac | |
| | ggttgagcatacaagcaaagacttggtcacgtggagagtgaatcaattcaagattcttcatggctcaactcgtccttggcttcacgacgcaaaacaggctta | |
| | cctctcggttggcacctttgacaccgacaacgacgactgttcctccaaggcctgaagcctgtaccacggatctcccgacctcgttgagggcccacctttcgacttccaac | |
| | ggaaagtccacctaatctgtcgacaaagtacaacaattgtccccgtcccatccaacaagtcaccgtcaccacctgacctaccacggatacggatacatggtgagg | |
| | atttgtgctgtggggatgaactttccgacagttcatcaacaacctcactcgcgtgtaagcccctgtgtaagcggcct | |
| | cggtacagaaccggtcttgggtcctgagattccactcttccgctctccggtctcatcttggccattcttcgctgcgaactaataacaagctgatgaggaccgtact | |
| | tacgacaggcccgaccacgtactcagcagatgtggtgcaattcgaagtggtgggccgcttggtgcataaggtgacaaactggaagctcaccaccttcaatgtggaatctgc | |
| | ctcaccagtcagacccatatctggacgcaaccgttaccgcaggccaattcgacatctgaactgatgaggcttgagtcaacaagtaacgacagac | |
| | ctcaccagtgatcctggtgcccacactggcctgggtccagacgaagtggccaacacgttcgattcgagtcaatcttcatgatgtggccaagaaaacc | |
| | aagtaggacacaacccaacatggcgccgtggagtgtacaagggcatgcaaacggtggtaccgagggtgaatcaatcgacaagtagtgggagaagtacggacagac | |
| | gaggccatgaaggcttttctccaggacatatttggagctccgtctgtgttggactgactcgactcagtctgcaattaactgtgatcaaggcaaactccattcctctctgatctga | |
| | tctggtctgtcctcggctctgtgttctgggaatccagtcagtcacgggtcaactgcccagtgtcaacgaaaactgcgattctggatgatcatttaagacacagtgatcaatggatttagcacagcttgcctttgaagttca | |
| | agaacgcaggcaaggcaccatgttccacatgagaacccagacatgaaaagcggcatgatgggcttctgttgcagtgacgcc | |
| | gtactcgttctcaagatgtatgagtactccaaaaccatgtcaagttcgtacagcttcttaggtgttcaaagtgatctcacggttgttgtatagcgtgtcgatccacactagtgtacgaacgaga | |
| | gtgtcggaattcgcctcggcctaacgaacaacatgaaacgctggactagatccgctaaggatatccggttgttcggtatgaccccggggatctgacgggtacaacgaga | |
| | attgtattgatcaaaagacatgattggtgttacgaagaagcaacaggagaagagtcaacaaggaagacaagaagaagaagtaaat | |
| | gattatccaccaattgattatataacaaacaaaccaaggtaacacaagatattataccactcgatttgatatctcgtgagtcacggtatgctcgaatccagacacataca | |
| | aagtattgattatatacaatataaaaacaaaccaaggttgccccaagtgccaagaacaaccaactgcccgatcgactgtcgccgatgattgtgcttgt | |
| | gagtccttcgtctcgatttgggaacaccagccaggtcttgatatttcgaggacaagaagttctcttgcatgaacaccggaagcgtgagatgtcatcgcag | |
| | gcttgcagagcgccacggcggtcttgatattcgaggacaagaagttctcttgcatgaacaccggaagcgtgagatgtcatcgcag | |
| | cggatcatggggaaagaacacgtttgattatttgttattgcgggagaggtctgtggagtggtgttgaaagctcagtgctttatgggatctgaat | |
| | ggagtccccgactcccgactcctgggcattcttcttgctggcctggaacgcccaacgcctcgcctaaccacgtccaatctcaataaacttgcaacgcccaccacactagtccaatcactactacca | |
| | atgaggcagcagcggctattctgacctcagagggccacagttcctcgacatgatagagggaaggttctggaaacctgtgaggaatactcgactgcgaattctgactgccgaattcctgactgcacacctg | |
| | actcggccgcggcaattctgcctcgagcacatcccccttcgccagcaccccttcgccagcaccctacactgcccgtttcaacgtagaccccagagcc | |
| | gcgttaccaacttaagctccctcgcagcacaatcccccttcgccagcaccccttcgccagcaccctacactgcccgttcaacgtagaccccagagcc | |
| | gtaccggcagttaaggttaaccctataaaagagagctccgtgaactttaccggtatcgtcgtttggatgcagagtacagggatgataccaccgggtgatcccc | |
| | tggccagtcgcagcttgctcgagtaaggtggctgatctcagcaccgcgaaatgacattaacctgatgctcggggatgtggaagcctggtcgatggcagtgt | |
| | ccggtccggttatcggggaagttggcttgaccagggtaatttcagcgtgatcttccaaagccataaaacgtcgaccccagaactggcttgtagtgcagtgctactctggacaagg | |
| | gattatcaaaaggatcttcactagatcctttttcaactagaagagcaggagtcaagtcgactgaatgtcagctactgggctactctggacaagg | |

TABLE 20-continued

| Plasmid | Nucleic acid sequence | SEQ ID NO |
|---|---|---|
| | gaaacgcaagcgcaaagagaaagcaggtagctcgcagtggctacatggcgatggtggctagactggcggtttatggacgcagcaagcgaaccggaattgcag<br>ctgggcgccctctgtgaagttgggaagccctgcgcagttaaactggatggcttctccgccacgccaaggatctgatgcgcaaggatgccaagctctgatcaagaga<br>caggataggacgtttcgcatgatgaacaagatgcacgcaggttctgaacgtgcaatcaagctggcacaacagacaat<br>cggctgctctgatgccgctgtccgtccggcgtcagcgagggcgcccgttctccttctgacgtgtcactgaactgctgctggcgaagacgaggcag<br>cgcggctatcgtggctggccacgacgggcgttccttgcgcagctcctgcgagaaagtatccatcatggctgactacgttgatccggctaccgccattcgaccacca<br>aggatctcctgtcatctcacctgcggctcctgccgagaaagtatcctatcatggctgctgatcaggacgatcggaagcgcgcttcgatccgcgactg<br>agcgaaaacatccgcatcagcgcgagcatgcccgacgggtctggacgatctcgtcgtgacccatggcgatgcctgctgccgaatatcatggtgaaatggccgcttttctgattc<br>ttcgccaggctcaaggcggtggtgtgcgacgctatccaggacatagcgttgccgattgcatggatgcaccgcgctgttcctgaccgcttcctgt<br>atcgactgtggccggctatcgcgctcccgatcgcagcgcatcgccttcctccatcgcctctgcgaagctctctgaatattacggctttctgatgcggcggcggatttttctccttacgc<br>atctgtgcggtattttacacagcaagtcgcgatttttcagaaccagatctgcgatcatatcactcatcaatatgttatccgctcatgcatgagac<br>aataacctgataaatgcttcaataatagcacgtgaggaggccaccatgctgaccagtccaagttgacacaagtgccgtctccggctcacccgcgaagcg<br>gtcgagttctgacgaccggctcggattcgcggcggacttcgtgaggacgacttcgcgagtggtgtcgcagtggtggcacagacctgtcacgacttccagg<br>accaggtgggccggacaacaccgccggctcgagcacgccccgagcgtgggcggtcgacgccggttcgccctgccaagctgaagtggtcgcctgcctgatcccgggacgcc<br>tccgggcggcctgcggcaacacgctggcgagcagcccgtcgccgcatgtggcgcagacccgcaaccgtgcaacctgcactcgtgccgaggagcag<br>gactgaacgtgctaaaactcattttaattaaagatcaaggaagatccttgataacctcatgacccaaaatcccttaacgtgagttttcgttccactgagcgtc<br>agac | |
| pAA1164 | cccgtagaaagatcaaaggatcttcttgagatcctttttttctgcgcgtaatctgctgcttgcaaacaaaaaaaccaccgctaccagcggtggtttgtttgccggatca<br>agagctaccaactctttttccgaaggtaactggcttcagcagagcgcagataccaaatactgtccttctagtgtagccgtagttaggccaccacttcaagaactctgta<br>gcaccgcctacatacctcgctctgctaatcctgttaccagtggctgctgccagtggcgataagtcgtgtcttaccgggttggactcaagacgatagttaccggataagg<br>cgcagcggtcgggctgaacggggggttcgtgcacacagcccagcttggagcgaacgacctacaccgaactgagatacctacagcgtgagctatgagaaagcgc<br>cacgcttcccgaagggagaaaggcggacaggtatccggtaagcggcagggtcggaacaggagagcgcacgagggagcttccagggggaaacgcctggta<br>tctttatagtcctgtcgggtttcgccacctctgacttgagcgtcgatttttgtgatgctcgtcaggggggcggagcctatggaaaaacgccagcaacgcggcctttttacg<br>gttcctggccttttgctgcggcaactgttgcctttctgtgtcatgccatgccaataatggttggctctgagctgttggtccagcagcttaatgcgtattccccctgattctgtggataaaacgccatagcgcagcctgga<br>acgacgagcgcagtcagtggaaagcgcagggcagttgccgcagccaatattaatatgcgccaatagcccccgcctcacaaatcagcttcgatttataagcttacaataagatccagagctggccaactacttagtgaactacactagcccggaacgggaactacagacctggcaggtgctgagagatccagctaacatatggaagccgg<br>accgttttttgatccggcgaagcgaagctcctaaccgggagcatcaagctgccaacagcaaagcaagcgatatctttaaagaagcagctcaggttggtgtcatcagacatcgccaagaagaccttaacagggatctttctctctgctaatataagtgaccctcggaaagcagtaaatggcttccctatttggcaaactagactgggtatgctgtgacctgaaggaaccatttccggtgaatgcacccaggattatcgacatctaacttacaccttcagttcctttctaagctgaggcatatgatcgagccaaattatttcggtaccttaccccatctgagctatcagcttttggcttagcatatcacaggaactgaacaagacgatagataatacttcgcaattcagttatctgttcttttcgtcagtaggacaagcgctgtgtgctatcccttctgctcatcgctggcagggaacagcgaattgctaagagtcccaataaatctgccaaacctgcacctttccgcaggcggtccagtaggttcagccaacatctgttgaatgattcacggcgctatcggcagctaacacattcaagcagcagcaacacatcagcagatccgagccttgatcaatagctaactacaagcatggatgatctgagatactcgaagctgagtcttgccagctgctgatatccgaagacatcgtcatcagcagtcagtaggacgtgagccttctccaacttcccagcgaaaccgcatagcgaccttcacaccctcggtatccgcgcagctcgctagattctgaagttgtaggataggtatgaccaaggcattcccgcacagaagattatgtgcgacctcgtctgctgcaagctatcttttaaaatacttctgatatgcaccaacccatctactaccgagggtagtagccagtatcccaggcaaggtctgggcgatgcaccgacgcatgaccccagatctgtatcaggatgcaggcacctgggtgttgcacaacctgcacaagaccggacaccgagaagctgtcgatctcttcaaggttattcccggcgaacgtgagaaagcctcttatcggccctgcgagcatcaccgctggcgttgagttttaacttagcttttatcacctggaaccttggccgcttgcttgcttcagccgatagcctcaggtttgaccgtgcagctcttgagcaactgagaaccttctcatccgctcaaaactctcttcaccttggctgctgatctgagaagcaagtgtagcgctgtcaaccatactaaacacgtacttcgctctcgaaaccagcccgaacagtgacgacccttttcatccgagctgttctcatccctattaacgacgtgtctgattaccaagtcgttctaataggcatagagggccacctgggttaatcccgacagcagaacggatactgatgcaacgcgcagtcgttgagtgaagccgtgacgttatcgtcctgcaggccgatgaacggatcgccgtctccggaactgcgcgctttctgttgaatgtcggttatcacatcgctcagattcagtgcgctgaactgttactgggctactccctgttagaacaaataaatactagctctcaacttgcgaccctcggatctgttctgatatgggcatcttggccttctaaaatggggtgagatgaatggctatcaagggccgtctactgtgcttcttctcgctcttttaagggcacacttggagactctgtacatcagcaagcgtacaaggacccttgggagaacaaggtcaagcaggcagacatctggtcctagaaaacggagttcccaggtgtcttgaatgtcgcaactgctgtaagacggtcactgggtatgatgtacctcccagaaggtatcatcaaggttctcagttgtctaccttgagttcaagccgacggcccgtttctcacacagtggagtctcctgaccaaccactccagggttagaactgaggacaaactaaaacccttgtgtcttctcagaacggccaaaacaacaacctcagtaggcagctccttgatcgaggtttgggtcgacacatagaacctcctcgagccggtggaaatgtccagctgtgtgtcttgtattgacacaccagcagtgccgagggaccaccaatgtgggggttgggcaccacaattgtcaaagcttggttgatcaggcccaactgaggctcttcaaca<br>tacccatcctggtgaccaatcgtcgagctgcttggcaaccgtttagtactggctcatcgtcaccttgacagatcatttcatgctcttcgctcactccttttctctcggcaaagtggctagtctgttcaatacctgttcaaggcatactagaacctcaagtgacaactctgttt | 112 |

TABLE 20-continued

| Plasmid | Nucleic acid sequence | SEQ ID NO |
|---|---|---|
| | atggtccagtcagtagaagaactggagttggtaccgttggtacccacggaccaggaaacaaaccaagttgacaccgattctggttccgacttgtgggtcaaagaca | |
| | ccgaggatcgacaatctctggcctgttggcctgtggcctgttcttggcctggctgctcaaagtatctggagcagtctgcaatcttcttgcggtgaccttgtctttgttgcttgtcaagttgt | |
| | agtatgaagcgcgacctcaagataggtctttttgcattgctgacatgtgctgcagagccttcttgggatgaaccttcaagaagttcttcaactcctttgggtt | |
| | gaacttggtagtctcttctttgaagttcggtaggcatgattgattgcttatagttcttcttttcttgaggatgaccagatgttgatataatcagataggtaggaaaag | |
| | aataaaaaactatatggtaggaagaagaaaaatggtgatgtgaagacactgaagaagtgggggtagtgcattggatgtcatgtggataaaatgcctgttttttctgt | |
| | ccagagttgccctgtgatctgcgggggccacacagctgtcgtgccccccaggctaataacaggatatctcaactacagtgctgcaaaatag | |
| | ttcttcgatcgcatttgcagcggcagcaactttgcttatcacagacgttatcacacttttccacactttaattccacgctgcaacaggtcccaaacacaaaccgccaaaatgcctattacatgagccaccacc | |
| | gaatcaacaagcaatggttatataacactggttattttccacacttaattccgtggtcccaaacaggccaaacaccccaaagacctttactcagaaccttgatctcagcttttcctctcc | |
| | gctctaaccaagggattctccatctctctccgtggtcccaaacaggccaaacaccccaaagacctctgtatctacgtgcagttaattacatc | |
| | aactccagctcttctctcctgcgacgatcctgccatgcgaacagcggaagcgttcttcaagtgtattacaactcgtacgtgcatcctcaagcaa | |
| | gtgatggatgaagcaaaggcgaatgtgacgtggttgaggcggcgtggttgtcagaaccgactgattcagcagaacctactctagaacttaacctcaatgcgtattg | |
| | gttcgaatcatgaagaactaaatacagacaactcgaagatacaatgacctcttcctcacacgactcgtgtatgatagactattttccaaacaaacctcttcattattacatctaactg | |
| | accagtctctctcaagtagcttcatccagcatccgagcccaaccgtcctctatacgtgccccaagccatcgtccctcctctacatgcatgaggatgatcaatcaaaccctcttcctcta | |
| | agtcagaaccaccctcaacgtctccatctgtgcgccaattccggtataggcgctcgtgattgatcccgacctcactcaagactgcgccacagagccttactc | |
| | cccccatgtccgctgccgatgaaccatcccgtttccttttctcctaccccgaggtttctcaacctttccggtgataatcctcacagcttgccaacagagccgccttactc | |
| | gaactccgccaacatccgatccggtatacccccgaggtgctactgcaacatccacgtgtctcgatatcacgtggtgcttttccggaacttcctgccctgaatgaaccgtggcgcttgc | |
| | actccacgccgcgatcggtactcaactccccgggtccaatccgctagtgaagtcgagcgcagagtgatgtcagctggcttcacgagacagatgctcgttgcgagcgaa | |
| | aagcgcacggcccgttggtcacgtcgatcgagggcgcagagtcgccaatctcgatgagtgctcttttggactcattaacgcgtcgttttacaacgtgactggaaaaccctggcgttacc | |
| | ccgctcgagcatgcatctagagggccatcccctttcgcagccgatccccttccgagtcgcagctggcgtaatagtcgaagcgcgtcccgatcgccagcttacgacgga | |
| | aactaatcgcctgcagcacatctaaaagagagggcgtatcgtgtttggaatgtacagaggttggatattactgacaccggggcgacgatgtgatcccctggccagt | |
| | gcacgtctgctgcttgtcagtaagtctccgtgaacttaccggggatgcatcgggatggcacgatgcaccaagcccgtggccggtgctc | |
| | gttatcgggaagagggtgctgatcctcttcacgtagaaagcagccgtctgactagggcagtgcagcaggtactagccgtgaatgattctgacaggaaaacg | |
| | aaggatcttcaccctagatcctttcacgtagaaagcagccgtctgaccccgatggccagttgtcgaccccgtgatcaaaacaacg | |
| | gccctctgaaggttggacccccgaaagctaaacgtactaaactgaacggcgcttcctccgcccaggtaggcttcctgataccaagaacaatg | |
| | aggatcgttccgcatgattgaacaagatggattgcacgcaggttctccgcctgctggttgagaggctatttgattagtggcacaacagacaatctgct | |
| | ctgatgccgccgtgttccggctgtcaggcgagggctcgtgcagctgtgctcgacgttgtcactgaagcagaacggcgctgcggtgtcgctaagcaggcacaagacgagcgccggct | |
| | atcgtggctggccacgacgggcgttcctttgctcagtgcgtctggctgctcgatgtcctgcaccactgccctgttgaactccggccaagctgaaaatggtggcattcctgatcgtc | |
| | ctgtcctcaccttgctcctgcgcgtcagaaatcatcatggcgtcctcgtcgttccggctaagtagcgacccgctgaagtctctcttcaatcctgatgccgccaagttcttaaccaccaagaa | |
| | catcgcatcgagcgagcacgtactccgaccgatgagctgctgtcgatcagtaagtctgctcgtgtcgcctccggcggtcatcatgctgccaaggcccgtggctcaa | |
| | gctcaaggcaagcatccaccgaggcatgccgaggatcacatgttccgaatatcatggggtggaaatgggtgccgcgttctcgattcatcgactg | |
| | tggcgctggtgtgcggaccggccatcaggactaggttatggccactcacccgtggaccgccaaggatcagatatgtgcagcgctcgtgcgtcgccgttcctcctcgtttacgg | |
| | tatcgccgctcccgattcgcagcgcatcgccttctatcgccttcttgacgagttcttctgagcgggactctggggtttctacgagtttgaattttctcctcgcatctacgcatctgcg | |
| | gtatttcaccaccgcatacaggtggcactttccggggactcttgtccgaccagatcagaagtgcgcgaaccctctctctgtactgcatgtgccgtcatgatccaaattcttgcatacaattcaaatactttct | |
| | gataaatgcttcaataatacagggacgtgaggaggactcgtggaggacgactcgcgggttggtccggagtcgcaagcgacccctcatcagccgtctcatccgcttcaccgttcacctctgtaggacgttct | |
| | tggccgctgggtgtgcggcagcgatcaggaatatcaggaactgtcaccgggctcgaggtcctgaccaaaatgggctggctgaccgcttcctcgtgctttacgg | |
| | tgcccgaccggctcggttccccggtgtgtgggctcggagggacgtcgcggagcctggcgacccggtgctcactcgtgccgaggaggactgaca | |
| | gccatgaccgagatcgcgacgagcccggggcgggtggtgaggctcgctcccgtgcgcgcgaccgccgccggtgctccggcagggaaattcatcatcaatgtcaccgtcaatggccctcaccctacctggggcgctgttcgc | |
| | cgtgctaaaacttcattttaatttaaaaggatctaggtgaagatcctttttgataatctcatgaccaaaatcccttaacgtgagttttcgttccactgagcgtcagac | |

TABLE 20-continued

| Plasmid | Nucleic acid sequence | SEQ ID NO |
|---|---|---|
| HDE1 promoter from Candida strain ATCC20336 | Aagggaagaagtcgttgagttgatgtaattaagctggcacgtagatacagaggttcagagtagagcttggtggttgcccgttttgaccacggatag agatggagaatccccttgttagagcggagaggagaaaaaatgaaacttgcatatcccactcattatcctgatgtaaccgttttatggggtaattaaagtggaaaa taatcaggagacatattccgatcaattggtggttggctcaattctgtgagtaggctcagtggtgttcagtggattggtagtcgtgtaagcagtgttata taaccattgctgtgatcctattttgctggacaactggtgtttgagatataccctgtcgtgtgagataatcccccatattcgcctgtgcagcaagtgtgccccgtg cgacaatgcatcagagaacagaaaaaacaggcatttttatcacatgcacacatcttcacaattcttacaatctcttaccccatatttcttttttcttcctaccattaa cagaatggcatcaggcgaattctgcggagccgcaatctattatatccaggcattgcatgcctttacaatcttcaggcgttcacaatcttccacaattcttcaac gtttttttttatcttttcctatttcctacttcgtcatccctcaaaagaaagaaatataacaatcattaatc | 113 |
| PGK promoter from pAA105 | Ttgtccaatgtaatattttccatgactaaaagtgtgttggtgatgtgttcttccttataagtgtgaaagaaagtggaagggacgttggtctgtcgtcttccttttatagttgttgt atagtagctcgtctaggagtctgaggagaggaggaagcttcctagtcggaagagagtcctgggatgatcacattttcgtggaacacatgggtgatgat ctgcacgcacatttgtgattctgcgacacgctgcactacccaagtgagtcttcgcccaccgtgaaggaaatcacaccttcaatttatctcaggcatgcaacac aattatacatagaagaggagtcacgatatacacctgtgaggatcatgtggtggctcggctggtggtcgaactgaattgtaccaaccccaccagtaa caacccccactcggccttcattggcaccaccgatgatgaaccaaaggccaaaagaaaaacaggcggtgggaattgttacaacccaccgaacc cgaaaacatacctgcaatctcccgggccccaatcacccaatacacaccgtctctccctccagcccctgtgattgcacacagcccaagtgagtagtcatgtttgattctgcaatttgca agtaactcaggttcagaagttggttggtggtgtttggtcctgtacacaggcattacactcacatggcctctgacaatctttccctcccagtgaacactttggctgctagtagtattttgcaat tccatgggatcaggtaactaagtgcagggtgggtgttggtggttggttgtcacccaattgaattgttccctctcgttacaccagcttggctagctattttcatgtatagaatacagcctttgatt ccccctcccctctctcttcctctgtacacccaattgaattttcaccctagtaaaagagttctgacaacacgctcaaaatatctctccaaaatatctgcctcaatagtaattaaaaccccgttattgtttcttgtcaagatgtcaaatcaataaatagttagaacctatacaatcaattgtccaatcaattactgaagattggcaccctccaacaaggcc tagctctaccagtaca | 114 |
| PGK terminator from pAA105 | Aaagtacggtgtgtgacaagttgtcccacgttctcacggtggtgctctagaagtgaaggtgtagaagagaaagaaagaatgtcaggtgactgctcttccaacaaggcc taaatcagaaatattattcgttaatagatgcaaacaaatcagtctgaaaaggttctaaataaaattctgctcacattctcccaaatagtgaaatccagctacaatt atgtatcaatgttattccgttcaaacaaaatcagtctgaaaaggttctaaataaaattctgctcacattctcccaaatagtgaaatccagctacaatt tagctctaccagtaca | 115 |
| POX4 terminator from Candida strain ATCC20336 | Gaatagaagagagtgactctttgataagagtgcgcaaatttgattcataagtagtatatctcattagtagacgtgcgaattcattaaaaaagcaaattc cgttgtatgcatactccgaacaaaactagcccccgaaaaacccctagtgatagtgcgaattaggtcgac | 116 |
| POX4 promoter from pAA073 | Gagctccaattgtaatattccggagaaatatcgttgggtaaaacaacagagagagagaggggagaagatgttctcggtagaattatataatcggttgttgttgcaaatgct actacgactctgcaatgctgtagctgtagtctgcgtagtgttatgccactcactaggtgtcatacacacgttaggtgaggtaaaaattgctgagttgcttcttt agctacgggtccccccgcgaaagtaaattacactgtgaattttgcacacacccgtgaattcccaacgctacacgcctgctccttttt ttttctctgcttccccctcgacttttccaccattgataataactaaatcaaccccactaacagttgtcaaatcttcacgacta gttatatttattacctcatcctttttgaatagtatcttcattatgtaagtagttgatcgaattaggtcgac | 117 |
| G6PI promoter from pAA2218 | Aaaatcagagggctactccggagatgggcacattatcacgtggcagtccatctggcgactgacaatgctcatctcagaagtgctcgtcattg ctagtcgtagtcgtcgtgaaatgctagcctggatcatgcgcggtaagatatctcgaggggtcgttagcaagtgttagtc cgcaatcgaccctggcatgtgcaggacgcgggtgcgagatcgccccaccaaacgctgcgagtcgctgaggtgacatgttgaatgccgcga aatggtacagtcgtattaatcctgcaaactaacatccaagattggtttggtgttgtgtaatgcacaagtctgtttgtggtgtttgtgctgtcactacgacagctgagatggccta gcaatactcaacggaggccacagagtattcc ggaatcagagctactccttgtgattccaagttccatatccaacaatgcatctacttgagagctcattctagaagtgctccgagccggtttctgaaatgtaacgccga cctccttgtcattaaatacacacaccaccatcaagacaacctcccaacacccatgccacctccacaacccctccctgccatctctcctcctcctcctcttttttttttccctggttctctgttgattattt atcaacctcatggtttattatctccaccggaaatgggaagaaccaccttaatgctggcatcgaggctgcaatctctctttctactccttctcctcctcttactcgttagattattt atcaacctcaattgttttatttctactcccaatcgcagcggggaacaaatttccttgaaccaattcgattaggcgatcgt | 118 |
| GPD promoter from Candida strain ATCC20336 | Cggaagttgtttaccgacctgaccgtaaatttgctgctgaagaaaacgtgcaacaagaccattcgcaagttggctcaattgacctgtgaaatgcttgttgccaccatg ctccaccaaaccctgatcttcctctgccccttatcttttttgtgtgttcaagctggctgatggctggtcaatgtccacgctctatttccccactgcaactttctcacgtttgttcctgatcaggctcaatcaagtagttattcgaa ctgctcgtcgttgtgagtgtggtagtcgtttgtggtgtcttgttttctgccttctctacttacgcctctgttcccttccctcaatctcagcccccatgtcaaca acaacaataggatagataatgccccggcggtgctgtcgcaacaaaccactacatttttggtaatcagtattctcttcttccccttctcatcacgtttcaat aaaaattgacaaaaaattataactactatcactcccaaaatcgaaattaactccccaattaaagaagattatcgat | 119 |

TABLE 20-continued

| Plasmid | Nucleic acid sequence | SEQ ID NO |
|---|---|---|
| TEF1 promoter from Candida strain ATCC20336 | Ctagcaaaggcttgatcagagaagcaacaaaaaaaactctatactccagaatacactccttagaaacacacaacaaacagctagactaccatgg actacgatgaagacgattagattacttctcaaggagaagaggaagagttgacgaaacaagtgacagaagagtacgactgtgtgcatacatgtttc ggagtgaagacaaaattgaagattacaatgtagagatcgatctaaggaagcgttatatacaactattcgatagacctaccattgaagaatt gaagacgaaatccaaaagagtacgtatataccactaaccaccaatgtcttacctcaccaacgccctacaatc ggaaaaaaaaatctggcaaaaaaatatc | 120 |
| PEX11 promoter from Candida strain ATCC20336 | Gaagatgaagcgtatgagtattatgagtactgtcggacgtggaagtggcagagttaagccgagaagtaagccgagaaagcaagagaggatggagatgatgagtgcgg ccaaagatgtgaaggctgcgtatctgttttgatatagcggtgggtctgtgagtagtggtctgttagccacacgaagctgttgattacgtgatcttacttaactacgtcaaagcaatagaaatatcaacaa agtgggttgtaaatagaaaaaagtgggttgggtctgtgatcgttagtggtctgtatagccacacaccaagtagcaaccagagagcaacgacaga cagaaaaaaaagttgatccccacagctcaacccacagtctaactctcttcttgtcctttaaatataactt atcaacgaaaagattctgcaaatatttctgactctcttcttgtcaaatattttcccattaaaaaaattcctcaacaa | 121 |
| pAA2214 | cgaattccagcacactggcggccgttactagtggatccgagctcggtaccaagcttgatcgatcctgatattctatagtgtcacctaaatagcttggcgtaatcatg gtcatgactgttcctgttgctgtcggtatcgacgttcgcacacaatacgacacgcctaagaagcgtgtaaagcggtgtaaagtgctaagttcctgctaactc acattaatcgtgctcctcgctccactgccgttccagtcggcggttcgcagcggttcgagtcgattgaatcggcaacgcgggagaggttgctatgg cgctttcgcttccgctcctcgactcgctcctcggtgcgtcgccagcgcgggaaaccgtgccgtcggcgagccagctcactgccaagaacaccgt ccgcagaggaatccgctgacgactaaggaaccgtcagaaccagcagacaatgttcctcgcttgcgcagttgatcgctaagagaactgaaattgttc ctagccgcctcgactaccgtcaagtcaagtagggctacccgacagtggcggttccaaccagtcctcagcaagggactataaagataccaagagtagttcctctc ctgggtctgtgcacgaaccccccgtgaagctccgcgattccgcgctccaatcctgagacactgtgagtactcgttgttcatcgctgctgtgagtatcgactgagatatcaa agcacatggtaacaggtctaggacgcgggtatgatggtgctagagcgtagcggaccacaaacacccggtctgtgcatcgtgtcgttcgaagcagatcc ggcaccaccaccggaaagctcccggaaatgttaaccggtctgtagacgccagctctccaaggacacaagcaaacctcagcgggatagttggttcatcatgagattatatcaa aaggatcttcacctagtccttaataataaggtttagcatgccgggcacccacccgctgtcttcatgcgcccagaaggtcagtggtcaacggggcc gaactcccgcccaccaccaaccagcagggtgttccgccagcccgtcgccagcaacttggtcgcgaccggtcttcagcaagcgggcaagtcgctgttgcgggagaggcagttcgacacggaacagatgtacagacctacaaccatggtgatcgcaacacgcggagaagcacgtcacgctctcaggcgga agtgtcctccacgaagtcccccgaaagtcccgggaggcaggaagcagcagggtatgttctgtacgagcggagcggtatgaaatacaagaatacagagaaaataaacaataggggt actgccacatgggtatacgtacctatactggcatccttcctagctacgctccgatactcagcagacgagagcggcccattctgatccgagcggcaagccacatcgaggaagcggtcagcgccaag ctctcggtccagatcactcctgatcagaagacggcttccggatcatctctcggcaagtgagacacggcagcagacagcccgaacatgacgatggtcgtccagctgacatcagcca cctcaagcaatatacaccaacgaatctgatcagtctgtctctcagtgctgcccaggtccgaatcctggcaacagtgccctcagtagtcaggcgga cacggtcggtcttgaaaaaagaggccggagatcacgggccttttgaatccgagagaagctccaatctccctgtttgagactggaagctctgcattgtgactgtgatcagcgga tagctcctgccgggcagaagccgcatcccagttacttgcagggcttccatcatgcatggcgcaaaaccggatttactgaccatggcatggtgcgggaaggcgatggttgttaaaaacaacgacg cgccagtcctggcggagaagacctaccccatgcctgctagctcctgaaggcaacaaggatcaggtgagaagtcttttgtatgaatattccagaactaagtggcgttttttg acgtcatttcgcggtcggctcgtgagatctggcgagtgagcagcacctctcccgatctggaagatggcagcggtgcacatccgctatcagccctgttctatt atgcattcgcggttgggctaggggaacgtcacgacccggtgatcgcgcccaagcctgcataggcgcatcatcacctcgcagcagtgcatcaagttcatcccgatgtca cacccggtaaagtcacggagcagttatctgacggaagccagctgtaacctggtcacaccctcgccgcgggggatcgtggaaggtgcatggatggtgcgggcctcttgct caaaaaaatacggtctctcttttattggaccaagcctaaactgccactatagctccaggtaaccacgcacgggcctgaactgccagaagacgacgaattgtaa attacgcagccgggacagaatgttgggcccgaaataccgagagtcgtccaaatctgaatgttcccgaaaatacctcaagggttagttacatgataaacaacaggccagtgtaa tacgactcactataggggcgaattggcgctcgagcgtcgacatgtccgagagtgtccagggtgttagtacatgataacagggcggcggaagtgtttttgactgtgtagctagtcgctatatgg gggcgttctcataggggggttttctttttcaatctcggtgtcaatccgcaggagaagctagaggagaaggagagaggcggaagtgtttttgtgactgtcgctagtcgctatgcctatgg ttgcataccggagaccaccccattttctctcgtgacaccctcgtgaacaccagcagggccgatgtcgatcagagggacgttagctctgaatccggagaaagagaccttgacgacgaagaatgcttta ccagcaccagccccatcagctccgcgttgacacccgctgctcgacgagcggtcgacggcatgccggaagtgttgaacaggcggggcgatgggatgtggcctcctatgg gtcataccggagaccaccccattttctctcgtgacaccctcgtgaacaccagcagggccgatgtcgatcagagggacgttagctctgaatccggagaaagagaccttgacgacgaagaatgcttta ccagcaccagccccatcagctccgcgttgacacccgctgctcgacgagcggtcgacggcatgccggaagtgttgaacaggcggggcgatgggatgtggcctcctatgg ccagcaccagccccatcagctccgcgttgacacccgctgctcgacgagcggtcgacggcatgccggaagtgttgaacaggcggggcgatgggatgtggcctcctatgg ttgcataccggagaccaccccatttttctctcgtgacaccctcgtgaacaccagcagggccgatgtcgatcagagggacgttagctctgaatccggagaaagagaccttgacgacgaagaatgcttta | 122 |

TABLE 20-continued

| Plasmid | Nucleic acid sequence | SEQ ID NO |
|---|---|---|
| | gggggtgttcttactggggggtggtaggacttcggaaacacggagtcctcttcttcgaacgcccccggttgccggccggtcgtcgttgatcccctgcagga<br>aatcagaggctactccggagtggcacattatcacgtgggacttcctgacaatgcactgacatgcatgcattctagaagtcgcttgcgtcttccattgct<br>agtcgttaggtgtcctactcagaccatatgttggctggtgtgggtgaagggcaactctaggaggagcaactcctactcgaaagtacgaaaggccgac<br>gccaatccgacctgccattgcaggacgcgggtcgagatccgggtgccctcctctgaggttgttccagttgcataagaaattaataatcgttagtca<br>atggtcagattaataatcctgacaaacgtgtagtccggggtagccactagtgagtcatgaggttatttgtcaacctcctcctcctacggtgtgtcctctcctcctcc<br>cttccctttgtcattcaattgtaaatcacacaccaccaccaccttttttcttcacttcttcctctttctcctctgttctactgttagattattta<br>tcaacctcaattggrnattatctaccaccacacaacccgccatcacctcacctgtccaagtgcgattcagttgttctgcttagcgataatgtaaatccttgc<br>tgccggtggttggttggggttattgccgtgttgaccggtcatcctcagaggtctttgcctcgacggggtcatgcctctcttctcctcgggttacgacgtgggtaagaaatt<br>acaatagccaagacggggtgttgggtatacagaggggtgtttggggtgtcctcagggttcccacccaatgctgctgttcacccaatgctgctttctgggttacgactgtgggtaagaaatt<br>ggtttctcctccactgcaagctcgcaagtttcgaatcgaaaaccctgttgactgccgttcatcgacgcgcttcacccaagggttgccgctccatccgaaag<br>agtcaagtcatgatgcagatccaagaggtccaagtgccaagtccatggctgccgtgtcgtgctgaaatgtacaagaacccggtgatcagatccactcttcaaggta<br>ctggctacttggccagagatgtccaggtctccgtttgatttcgcacttatgaagggtcaaggggacttgaccctgctgaagaattgacctgctgggttgtatta<br>cactcggtgtttcgcgtgttatgcatggggtattgccatgggtgggtcctcccaatgcccaatgccctagcacccaagcttccccaacgtctacactagtgtcctaggacgt<br>cattgtagttctcgaagttgctgtcagttcatgatttcgaaaaccaataaccgcaagtggattgtagcaggtagcagtcctctgacaaaccagagt<br>acgcgctcaaccacgtcaactctgcccttgcctcatcgacatgatcttggtttacagaacatcaagttcttgacaacatcaagttgtaataacccctgaagacgcttcgtctgacg<br>ggtacaacgagaattgtatgaattgatcaagaacatgatcttggtgttacagaacatcaagttctgaccagactgaaatgcacagaagcaaagaagaggtgaaccaagag<br>ataaggtgagattctatccacaattgaagaaagagttatgaaagttgtcaacagaagcagagtggtcaacagaagcaaagaagaggtgaaccaagag<br>aagaagtcacatagatttgtattatataacaacaaagtaagaaggaatacaataaattgcatactcagtcacgtagaacagttcttacattcccaact<br>ccaagaaaaaaaagagagttgaaaaaaaaaaaatcaaacccaacgtcatcatcgccctcaacaagcagacactcaatgcgatgcaatgcatatgatgtagcacaa<br>aaacatacacagaaaagggcatcagcaacctcaagttgcccccactcgctcgtgaagacccacatgatcatcgaacgatcatcttcgcctcagctcagctacgaggacgatg<br>ccacaccgccagtcctctcgcctcacaaagctcgccgagggcccaaagctgtcctgatatcggaacagaaggttcttgttggagactactaaacccggggtataccg<br>gatcgcgtcgtgatcgatgacgtgtagctctgccagctgatagcacgcgcagtgaaccaaccgtatgatgaggtctataccactagcttcagctcattgagcttc<br>gaagttctcgtagttctcatgattctgaaaccatacgcaatgatgaggctcagcagactggtgaaaaccaagagaaatcatgatgctcagaacagaaatatagaagacttc<br>aaccacgtcaattcgccccttgcttcatccgatctgcttcaaggaaagcagcagtgtaatacaacaactagtagaagaaatagacaccaactagaagactt<br>ttccatccgtcgttactcaatccggatcttgtgaaaaaaaaggaaaaatctacattaccacaaaaacgtgcttctcgatcgcaagaagtgttttcgaagactg<br>cggatttcgtcgcatgccgtgatatcaactgtcacgtacttcgcaactgagggcccggtatggctaagcagccaaagcttgtccaaagctcgatttagagtg<br>acactcttcccgtctgatcatataacaactcttcgtctacaattgggccccattcgccaactaccacttatccattgtcgaatcactagcttatatacccaac<br>acacacacactacatataagaacctcctgtcactgggggggtatgggagagacttgtgttgaggagagcaaggaccacttgctacctgctgacatcagaaggaggtta | 123 |
| pAA1116 | taaacgttgggcaaccttggaggggtgtgctgcctttctgtgctgatgccttcttctgttttgttgcaattgcgatgagctgggtttgatgacgatgatgggaggttg<br>atcttgggttgattttcttcattcttctctctcttttctctgggagttgggggaatggatgagaatcctcacgtgacctagtcgatcctcacttgtta<br>tataataatacaaaatacttacctcttcttttccttttgcttcctgttctgaagactctctcgttcgtgtgaccacttcattattggatatactccatc<br>catttttatccacatgacgccttgatatctgcattctgcttggtcatctgcactccgggagggagcgtggcactgctctgtgcaacacgatcatgttgtgtgtgaacaatacaagccgtgtacc<br>cgttcatcaactgtgcacttaaattgcgactcaatcatatgaataaggtttgcgactcttatcatgaaatcaaatcaaatctgcaacaagaatgatcagctttcatcgcactgcagcttcagcagcttcggactrn<br>ttactctactaatattgaatatatacttaaggtctggacggtcaacatgtctggaatcaaagcctggagtatgcatatgagcctggagtgggttcaaagcttcgaagtagt<br>cacctctttctgacttcgactccaatatccagtttctgcatcatgatcagcaggcttgaaacatgcttgttcttcgtgggtgggttcaaagcttggtcaacctggcacacaa<br>gtcgtagacgttacctcatcatacctcgctgacatctggggtaatgatgacctggtcctgcaaggtgcaccagtgccaaagttggtcaagaatcagtccggcatacag<br>ggctgggaagtgctcggaggaactctcagacttcgggtgatcgccttgaagaaaccgtcaatcaagaacctcgagcgttcaactggaagactgcagacactcacaag<br>aaaccaaaggctcaagactcagaacttcagaccattctgggtgatcgcttgaagaaaccgtcaatcaagaacctcgagcgttcaacctgaagcaacaatcaatcaagacaaacaaactg | |

TABLE 20-continued

| Plasmid | Nucleic acid sequence | SEQ ID NO |
|---|---|---|
| | gaccggtaatgtcgaaccctgtcttcagcaacagcaccaatgtctctgccaagccggaaagggcgtggtcgaaagccttaaccaacttggctggtcgtcaa gtcggaaacgctggagagaaccaatccctttgttctggctcctccaacaagtctctaacaattggctgcgaaagccttcatgccaagatgttgtcaccttccaggt acattgacaaccagccggaataggctttaccgaagagtaacgtgtaagaacgagtaccgtgaccaccaagcttgacgagctgcaatggcttcagcagtcaac cagtcaggtggactcaaaaaaccggaagcgacgaacaattcttgattcgacaattcgagcgtcaatggcttccttcaccagcactgacgagcttcgtcaa ctgtcgtggtgcttcaatggtatcggttgtgctcaaggtcacctgtcctctgtggacaatctcagaactgaagaatcctcttactggtcaatggtcaatggtagtcaa tcaacttggttcaaaccgagtcaagccaccgaatgtgcgatgatgtcatctactggtcattctgcaactactttgcaacataaagaattt gtgatctaccccaaatcaaagccggagtgacaattgtctagatacgtctactacctggccaccatgcacaactgctcccgacctggctgcgcagcatgtcaaggctacactccac cactgaccacaaaggcttgacaacggtgggtgatgatcgtgacacgtaacctctggtcacacctgtacaccttggatgcgcaggtgccaactcag aaacccaagttgacaccgattctgttgggtcaaagacgagatcgacaatctcggactcgtggtactcggtgagtgacgctcttcttcggaagcgacctt ttttaaggaagaatggtgatttaatcggtgtgcaaaaatcacaagtgtaattgatttctcgcgggggcagcagtgctaagacaactcagacaattttactcc acaatctcaacgaatacccgtgcatgcatcaagtgcacaactaagtccagatgcacagatgcactagctgtacgatgctagcatttgcaacaccagatt ataatctcaccgaacacctctctctgtttttaccccaacgatattctcccgaaatattactadttggagtctccaggtccaggtcgccattgccatgccga actagacgaaccgtcttcaggtacgtcttttaccaactcgtacgtgatacctccaagcaagtgcctccagactgcgctggcattaccagaactaacctcgggc gtacctggttcgcaggaacgctagcatctgtatgtatatataacaaccagttattctcttcaagtcgttttcgaaatcatgagaactcatgagaacctctacgaagactac caactcaggtctctttccttccccttttccccaaatgaccagaactccctactccagaacatgacaatcaaactcggcatccgtgctgcaacgacatcgcaagacgccgcctgttcctcattacgctgaggtactctgcagtgcatagctggaaacatgaccccgtatcccgagttgcgatgcgccaattttcaccccccaatctcctcttgaccccccaatctcctcttctaccttcctcgg cgtgtttccgatacctctaaagcaagagaggaccaagaacagcaaggtaatgtatcgattaagggactctatcgatatatctcaacgtcctcaagagatattaacagtccctgaagtggcggtttcggtagcgtacctccaggaggcaaccaagaggcaaacggtaacctcatggtgaccaccccagaggtcaagtcagatcggtcagttggctaactgaagctaactgatgcttc tgtgatcagaccaggtgctgtcagctcagaaggggctcatgacaggtatcaacaggacgccgcttctcgattccaggtggtccaaactgaacaagatgggactcaatggatgtttaccagtttcctgacgtcaatcgattgactgctggcccgcttcctcgggtcgcctcctggctcgccccgaggcccccggttctttt tgcgcccagagatcattgatgccaggggcatctggtggactgcaagtcgtctatgacaggaacagaactcggcggcggcgtatgatcccgttaacaacgaggaattcagcctgcagatcaggaacgacctgggcagcaggtgaaaccagtaa gtcaactgaaggcaccctgcgctccgatcgtccccgacgtatttctggggaacggccgggaccaaggaccaggcatctccatctcccgagagaaatgtatccatcatggctgaagctgtgtcgc aatgcgcgccaatggtcgcatgcgcttgatccggctccctgccatcggacgagcgtccaccagagccgatcggatggaagccgtcttgtcga tcaggatgatcggacgaagacatcggaatatcaagggccgcttctggggaatatgggaatatctacgaagcccaagccgatctcgcaggatcgctaggggaccgctatcaggacatagcgttgcta cggtgatctgctgcagaatcatcggtggaaatggccagctctgacttggcccggtgaccacagcagcatccagttgaaccagattgacgcacggttctccg gcgctccaagatcatgcgcagggcagttcggctgctgcagtatgactgacggacagacaggcggtgccctatctggcagcagggccccaggttctcc gtcaagaccgactctcgctgccgatgaacctcctgccgcgacggcaggattgaaccagcggcaggctcatcggctcctcgtctcaccgacgcgtcgtctcgttctctgcacgt gtgccaagtcggtctctccggagcagccggatgtcatctaagcccgagctcctgcgccgcctttcgggaaatggcgcggg aaccccttctgatttaccgttaacgctaacaattcttctaaatacattcaatatgtatgatcgcgcccgagcgaccgcggatcgaccgtcgaggctgtgtcga tcaagaagccgctgtcgagtgccgagtggtccggagtggccgaggcggggccggcagccggatgccgggcagcccggcggccgagaccggtcagacacccggacttc gctgtacgccggagtgcggaggtgcggagcggcccccggccccctccggcggccctgaccggccatcggcccggctgccccgatgaccgaggatcggggggggcggcggcgagtcgcc | |

TABLE 20-continued

| Plasmid | Nucleic acid sequence | SEQ ID NO |
|---|---|---|
| | ctgcgcgaccggccgcaacttcgtgctgcacttcgtggccccaggagcaggactgacacgtcgctaaacttcattttaattaaaaggatctaggtgaagatcctttttg | |
| | ataatctcatgaccaaaatcccttaacgtgagttttcgttccactgagcgtcagaccccgtagaaaagatcaaaggatcttcttgagatcctttttttctgcgcgtaatctg | |
| | ctgcttgcaaacaaaaaaaccaccgctaccagcggtggtttgtttgccggatcaagagctaccaactctttttccgaaggtaactggcttcagcagagcgcagatac | |
| | caaatactgtccttctagtgtagccgtagttaggccaccacttcaagaactctgtagcaccgcctacatacctcgctctgctaatcctgttaccagtggctgctgccagtg | |
| | gcgataagtcgtgtcttaccgggttggactcaagacgatagttaccggataaggcgcagcggtcgggctgaacggggggttcgtgcacacagcccagcttggagc | |
| | gaacgacctacaccgaactgagatacctacagcgtgagctatgagaaagcgccacgcttcccgaagggagaaaggcggacaggtatccggtaagcggcagg | |
| | gtcggaacaggagagcgcacgagggagcttccagggggaaacgcctggtatctttatagtcctgtcgggtttcgccacctctgacttgagcgtcgatttttgtgatgct | |
| | cgtcagggggggcggagcctatggaaaaacgccagcaacgcggcctttttacggttcctggccttttgctggccttttgctcacatgttctttcctgcgttatcccctgattct | |
| | gtggataacgtatccgctcatgagacaataaccctgataaatgcttcaataatattgaaaaaggaagagtatgagtattcaacatttccgtgtcgcccttattcccttttttg | |
| | cggcattttgccttcctgtttttgctcacccagaaacgctggtgaaagtaaaagatgctgaagatcagttgggtgcacgagtgggttacatcgaactggatctcaacagc | |
| | ggtaagatccttgagagttttcgccccgaagaacgttttccaatgatgagcacttttaaagttctgctatgtggcgcggtattatcccgtattgacgccgggcaagagcaactc | |
| | ggtcgccgcatacactattctcagaatgacttggttgagtactcaccagtcacagaaaagcatcttacggatggcatgacagtaagagaattatgcagtgctgccataaccat | |
| | gagtgataacactgcggccaacttacttctgacaacgatcggaggaccgaaggagctaaccgcttttttgcacaacatgggggatcatgtaactcgccttgatcgttgggaaccgg | |
| | agctgaatgaagccataccaaacgacgagcgtgacaccacgatgcctgtagcaatggcaacaacgttgcgcaaactattaactggcgaactacttactctagcttcccggcaa | |
| | caattaatagactggatggaggcggataaagttgcaggaccacttctgcgctcggcccttccggctggctggtttattgctgataaatctggagccggtgagcgtgggtctcg | |
| | cggtatcattgcagcactggggccagatggtaagccctcccgtatcgtagttatctacacgacggggagtcaggcaactatggatgaacgaaatagacagatcgctgag | |
| | ataggtgcctcactgattaagcattggtaactgtcagaccaagtttactcatatatactttagattgatttaaaacttcatttttaatttaaaaggatctaggtgaagatcctttttg | |
| | ataatctcatgaccaaaatcccttaacgtgagttttcgttccactgagcgtcagaccccgtagaaaagatcaaaggatcttcttgagatcctttttttctgcgcgtaatctgct | |
| | gcttgcaaacaaaaaaaccaccgctaccagcggtggtttgtttgccggatcaagagctaccaactctttttccgaaggtaactggcttcagcagagcgcagataccaaat | |
| | actgtccttctagtgtagccgtagttaggccaccacttcaagaactctgtagcaccgcctacatacctcgctctgctaatcctgttaccagtggctgctgccagtggcgat | |
| | aagtcgtgtcttaccgggttggactcaagacgatagttaccggataaggcgcagcggtcgggctgaacggggggttcgtgcacacagcccagcttggagcgaacgac | |
| | ctacaccgaactgagatacctacagcgtgagctatgagaaagcgccacgcttcccgaagggagaaaggcggacaggtatccggtaagcggcagggtcggaacagg | |
| | agagcgcacgagggagcttccagggggaaacgcctggtatctttatagtcctgtcgggtttcgccacctctgacttgagcgtcgatttttgtgatgctcgtcaggggggcg | |
| | gagcctatggaaaaacgccagcaacgcggcctttttacggttcctggccttttgctggccttttgctcacatgttctttcctgcgttatcccctgattctgtggataacgtatc | |
| | cgctcatgagacaataaccctgataaatgcttcaataatattgaaaaaggaagagtatgagtattcaacatttccgtgtcgcccttattcccttttttgcggcattttgccttcct | |
| | gtttttgctcacccagaaacgctggtgaaagtaaaagatgctgaagatcagttgggtgcacgagtgggttacatcgaactggatctcaacagcggtaagatccttgagag | |
| | ttttcgccccgaagaacgttttccaatgatgagcacttttaaagttctgctatgtggcgcggtattatcccgtattgacgccgggcaagagcaactcggtcgccgcataca | |
| | ctattctcagaatgacttggttgagtactcaccagtcacagaaaagcatcttacggatggcatgacagtaagagaattatgcagtgctgccataaccatgagtgataacact | |
| | gcggccaacttacttctgacaacgatcggaggaccgaaggagctaaccgcttttttgcacaacatgggggatcatgtaactcgccttgatcgttgggaaccggagctgaatg | |
| cctt | | |
| pAA2311 | ttccgcttaatggagtccaaaagaccaactctgcgcctgacgtgacctgatcgtgactgacaagcctggtcccactctgtctc | 124 |
| | gtgaagacgcaatcgatatctcagactttcagactgtgtcagtaccgatcagcgaggccacgatctagcctgctcctgagagcgacatcagtcctgagggacaggaag | |
| | gttgctgatatcggaaaccgtgaagggtgaaacgccggtgccgagggtgcaggggtatactgagggtgatgttgcgagtgtgctgccagtcgttggctggcgcatgtgaat | |
| | gcgtccttgaaggtgaaacgccggtgccgagggtgcaggggtatactgagggtgatgttgcgagtgtgctgccagtcgttggctggcgcatgtgatcat | |
| | ataccccgtgtgtggtggattggcgaaagagacagtctggcaacaaatctagtacgagcaatactcatggacttcatctgcacaggtgcgtggggtagaagaaggtttgattgatcat | |
| | catgacccctgtggtggattgatgataaaagcgatgcgtgggcagcatagaaccctgggcggtcagatcaatagagctgaccgtgattattgcctgggtcagtagctccggaga | |
| | ggtgtttggaaaaggaagaacccctgagtggggaaagatacagggatgcatgtgtgtccgaagttgctgcttgttccgaaacccctctcctgcgtgtgttgttaactgattattcacacg | |
| | gtaataaatggctctatatcatacactaagcttaggacgtttcataggctgagtttgtcgttatcgatcgacaatcccatgcagttctcatgattcgaaaaccaataacgcaatggatgt | |
| | agcaggatgtggttagtgcgttcctgtcgacaactagtcaagagctacgacgccctctcgttccatcgccctgacttcgctgtcaagttgctacacgatacacg | |
| | tcgagtgtatacacttgaagacgtcgtcgctgtgatcatcatgcagatcatcatcgcggagatatgcactccagatccaatcccataattccaagttggttt | |
| | gcagtcccatcctctgacaatgcactgacaatgtcaatcgcgaaatggcttcgctcagatattcccttgtggccttcattcccccgtgtttccctgcgctacccagcgcgggctgaga | |
| | tgtggtaaggggtcgcctctcctgagtgtcgttgttcaacctcctctctcctcttcctctacctggtgtgctcccccctactctgataagcagtcccgtgtgtagatcattaatctaccccggtattcaatcaaacctgccctac | |
| | aagcaggtgaactctccggggcgaagtgcgatgcacactggggacaatcgtaatataatataatccgtaagcgccacaaaaccgcccacactggaattggtt | |
| | gggtcgtgtaatgaacttttactctttttctctatctgaatatgccgatatctacgatcgctagataaagagatattaaaaattaataatatacaaccaagtggttt | |
| | acccaagaactcaccatccacaacaatggagcgacgtactttagccgatgtactttcggttctcgcgcagggttgatgactatcctgtaaatacccatctgtgaccgtcatcc | |
| | atgaccctgaaggtgacagattgtgaaacgccggtgccgagggtgcagacgttctcaagaagacgccgcaaatcagcgccggtgggacgctgttgcgcatgcaaaggt | |
| | gggtcgatgttgcacgcacatttctgaagacccctgtgctcaacaatagcaacaaggcgtggtacggcacatctcagaccaaattgctcattacggcttcatacggcaacttgcatat | |
| | cttgctcactttgatcatgtggctaactggttcccaagctctccaaccaagctactagtctgcagcaacatcattgatgacagcgcagggaaccttgccgggtgtatccatattttcct | |
| | tcccaattggtctccaacagtcctccaacctaagctcccactgggggtacacctctaaaggctcctcttctttcctt | |
| | gatgtggtcctgcctgcgcagagctttgcagagtggcaatgaagtcctggaacaccagggccacattgatggtaaaggttctcgacgagacggtagcagattccagat | |
| | gagtgactcttgatgaagcgccaaatcagtgatgcgaaagaaataacgtgcacaacactacaaggcaaaagatgggccatattcagtggatgcaaaa | |
| | ctcggactctttgatcaagcgcgccaaatcagtgattcataattcattatgttgatggacacagaagatgaacgatgtacagacatagaggcataaaaagatgatatagata | |
| | agagttggtgtacagaacatggttcaaccagaatcgtcttgagaaaccggaagctgatcacaaggtcatgacgaaaagatgagacttgtcaagaa | |
| | acaaagtaatggaatacagattttataaattgcactccaatcatcatctcatcaagagagatatctcgaatcaattcccccaaaaacatacaaaaaagtgaaaaatgaaaaaaa | |
| | ctccaaggttggaatttaaaggcgaattcttaaatgttttatacgcagttctgcatcatatgtccggtaatccggcgccagcaccacaaatacgccgaagcattaaagtgtaactggccaaccccc | |
| | tcggggtgcctaatagctgagctgaacatattaatttgccgcgtgaaattgcgcctcctccctcgcagcaccgtgttccagcgcttaagtgctgcaggcaaaggcg | |
| | ctggggagggttgccgagcggttgccgagcggttgccgagcggttgccgagcggtattgccgagcggtgtattgtgtccagcccagcccgggtatgcttcaccatcagcaagcg | |
| | gtaatacggttatccacagaatcaggggataacgcaggaaagaacatgtgagcaaaaggccagcaaaaggccaggaaccgtaaaaaggccgcgttgctggc | |

TABLE 20-continued

| Plasmid | Nucleic acid sequence | SEQ ID NO |
|---|---|---|
| IGR5-5' genomic DNA contained in pAA2153 | gttttccataggctccgccccctgacgagctccgtgtcctgctcctcgtcctgcctcaagtcagagaggtggcgaaaccgacgagacggatataaagataccaggcgtttcccct ggaagtccctgcgtgctcctcctgttccgaccctgacctgcgccttctcccttcggaagcgtggcgtttcatcagctcaagctgtaggtatc tcagtggtcaggtcgttcgctgcgtccaacgaccggtgcacgaacccgtcagccggcttatccgtaactatcttagtccaaccggt aagacgactatcgccactggcagcagcagcagcagtgtaacaggattagacagaggaggtagtgtaggcggctacagagttcttgaagtgtggcctaactacgg ctacactagaaggacagtattggtatctgcgctctgcgaaagtggtacaggaggaggtagctttgatctttcacgggctgactgtcagtgaacgaaaacttcacgt ggtgtttttgttttgcaagcagcagattacgggcagaagatccttcaagaagaagagctctttaaattaaaatgaagttagcacgtttaagacgccgcctcctcgcacagaagcacg taagggatcttgcatgagatatcaaaagatccttcgctcgcagtctcgtcatgctcgcgatctccgtgcatgctcgcgattgcggccacccagagaacttcaagtgcgaaggcacg cagttgccgaccactccgggctgcgcagggcgaactccgccgaactcccgcccgatctcgtcatggcgatcagctctggatccgtgtcctgacagctgtcctgacggcag cctcgaccactccggctacagctcgtccaggcgatacgctcaaagctgtcctccccacgaagtgcccggagaacccgaaactcgaccgtccggtccgacgttctcggctcggcg acgtgcgtccccggaccaccacggcggaagtcgtccccaaggtcccgggagaaccctcgagaaccgacgggccttatattcattagaccatatatttgaatgt gtgaacccgacccaacctggcctggccctcctccgtatttatgtcctcatgagcggataccatattttgaatgt atttagaaaaataaacaaatagggttccgcatcttcaagaaatgtgccaactcgtgcggttgtgaaataccgcacgatgtaaggagaaaataccgc atcaggaaatgtaagcgttaataatctcagaagactcttcagcaatacaccggcccaagccgcaaatgcctgatagtcggagtccctaaagcacgagg aagcggtcagcccattcgccgccaagctcttcaccatcttggcggcagcagctcaatatatcacctggtcctccttccgcgcacctctgctggaac ccacaaactgcgatattcgcacctacgatattcgcacctacagcctggcagcagcagcagcagctgtaatcgctgcagagcagcagctgtaatcgctggtaatcgcgcctgtctgctcgggggtaatcggccggcagcagcagctgtaatcgcggctgaac agttcgctggcgagcccctgatgctctcgtccgatctcgtccagtactactacagacctctgctgatcagccgtataatcgctgatacctttctcatccgtagtgcagacagtgcgagatcgtcgtcgtccagggatcttgagacagagccgg gaatggcaggtagccggataaaggctatcgcagcagcagcagctggaacgtccagaccatgctgatgagatgagcaaggatcagcaagatgctgatcgtcctgcc ccggcactccggcccagtcattcaggcggacgcagccccccccttcccagctcagtgacaacctcgaccacagctgcagcagcagcagctcaacctcaggtcctcc gctctgttgcccgtaggctcaggcccagtacgctcctcgctattacgcgtgtggcaatcctcattcgaaacgatccccatctgt cgatgatcgagctgttgccagtcagctcgcgaatacgcctcggcccatgctcaagctcacctgcagctacctctctttgcctgctttctcctgtcgacatag caattccggttccgttcgctgtccataaaaccgcctagctgcagccgctaataccgatctcgttcgcccactgtagtcggaatatcgatcctgtcactgacattatt cccagtagctgacattcatccgggtcagccgcttcatgattctcggcgcgctgaaaaaggaggggttaaaatatccaggaaacgaggacagccgcacatggtgcatca ccccagaacatcaggtaatgctttgatgatcatttgatcgtccccgatagccagcagcacggaccgctcagccacggggatacacagccagcagcgaggtatcatccgcccc catgcgccagcttcaataatactcacgctgtacatcacaaacagataggcctcctcactgaggtaaaacctcaactgcagatcagcagcagaggtgcaactgttgcc ggcgtgcaataatactcgtactctcatctgctactgctctaaacctaaactgcgcgtatctaaggctgcggcgcactgtgcaactgttgga aggggcatcggtccggggcctcttcgttcgtattacgcaatgctgcggaaagggatgatcatcttaggatgagattcctgcctctgcagctgaaaggggatttccagtcagctt gtaaaacgacggccagtgaattgtaatacgactcactatagggcgccctcgagatgcatgctcgagctgagctgagcgccgccagtgtgatggatatctgcagaattcg ccctt |  125 |
| IGR5-3' genomic DNA contained in pAA2153 | tcatgacttcctgtctctatctcccatacccgatagatgtgacgaagcgttgtgtgtgtgtattatacgcggtagcggtagtgatccgacaat gataaggtgcatgcatgcatcaacaatacctccagccatccacagtgcaaattataatcgcacaggagaagtgtcactctaaatcgaacagatggg agcggagaccacgtttgtgaatgttggagttctccttttcacctgcagctctctctttttgtgatatcgcagccgctgtagtaagacaccggagacactgaacacaccgcaggcttct atctaattcttttctatatagattttccttttttcacaagatccggattatagtaacgacggagaattgctcgcgtagtccccagaactaccaactagtgt |  126 |
| pAA208 | ggatcaagagagagagagcggcaaccagggcgttcgaagaaggagactccgtgttccgaagtctctaccaagagtcagtgaaaacccctaa agacatattccgtcaaagagttcctgcgtcgatggccgcatgccgcaggtgtcaacagagtcggaggtttgatgtgctggccatag gcaatagctacgacagtcaaaaaaactatccgactctgcttcccgccggcccgctctagtttatcctcagcagaggacgccggtgcagcagcagcagcagcattatcatta cttgagatgtagattaccgccctatcagtccagtgactcactggtcacttcaaggatctgggcaagcagcttatcctccaccgaatatgaaaaaccccttcgagcgccgc gttttgccgggtttattcatgctaactcaacctcaccaccgtccatggagctcggagcactcatgg |  127 |
| | tttccataggctccgccccctgacgagctcacaaaaatcgacgctcaagtcagaggtggcgaaaccgacaggactataaagataccaggcgtttcccctg agctccctgcgtctcctgttccgaccctgccgcttaccggatacctgtccgcctttctcccttcgggaagcgtggcgctttctcatagctcacgctgtaggtatctc agtcggtgtaggtcgttcgctccaagctgggctgtgtgcacgaaccccccgttcagcccgaccgctgcgccttatccggtaactatcgtcttgagtccaacccggtaa gacgacttatcgccactggcagcagccactggtaacaggattagcagagcgaggtatgtaggcgtgctacagagttcttgaagtggtggcctaactacgta cactagaagaacagtattggtatctgcgctctgctgaagccagttaccttcggaaaaagagttggtagctcttgatccggcaaacaaaccaccgctggtagcggt ggtttttttgtttgcaagcagcagattacgcgcagaaaaaaaggatctcaagaagatcctttgatcttttctacggggtctgacgctcagtggaacgaaaactcacgttaa gggattttggtcatgagattatcaaaaaaggatcttcacctagatccttttaaattaaaaatgaagttttaaatcaatctaaagtatatatgagtaaacttggtctgacagtta ccaatgcttaatcagtgaggcacctatctcagcgatctgtctattttctgtcattgttcctccgatttgttcatccgtagttgcctgactcccgtcgtgtagataa |  |

TABLE 20-continued

| Plasmid | Nucleic acid sequence | SEQ ID NO |
|---|---|---|
| | ggcccagtgtgcaatgatacggagacccacgtcaccggctcaccggctccagattatcagcaatcagccagcagtccgagcgagggcgagcgaagtggtcctg<br>caacttatccgcctccatccagtctcattaattgtgcgggaagtagagtaagtagtcgccagtaagttgccagctgttgccaacgtgttgccattgctacaggcatcgtgt<br>gtcacgctcgtgtttgtatgcctctcattcagctccggttcccaacgatccaggcagtactcagccaaaaagcggttagctccctggcctcc<br>gatcgtgtcagaagtaagttggccgagtggctatcactcatggttatgcagcactgcataatctcttactgtcatgcctaagatgtctttcgtgactggtagt<br>actcaccaagcaattctgagaatgtgtatgcggcagagccagtgtgctcttgccggcgacagtcttaccgcgtgagatccagtctgatgtaacctcagcatctttactt<br>tcattggaaacgttctttcggggcaaaactctcaaggatctctcatgaggcgacacaggagtgccacgaaaattgaatactaaccttgatactacctcctttcaata<br>ttattgaagcattatcaggttattgtctcatgagcggatacatattgaatgtattagaaaaataaacaaataggggccctttcgtctcgccgtttcggtgacggtgaaaacctctgacac<br>tgacgctaagaaccattattatcatgacattaacctaacagtaggcgtatcagcagacaagccgtcaggggcgtcagcggtgtcagcggtgcggctggct<br>taactacgcgaagcagatttgtcagagtgtacagagaatcacacaccggcccacatagccctcagcgccatccgcc<br>atcagctgcgcaactgtgggaaggcgatcggttgggcgctcttcgcttacgcagcaggcggatgtcgcaaggcgattaagttggtaacg<br>ccagggtttccagtccagtcacgacgtgtaaacgacggccagtgaattcggtgaaaaattgtgagtgtgcttactactgctgctgccccgcg<br>aaagataaatacaaattgcaccacacagattaacattccctaaaacctctcctctcttttttgttatattttaccatcccttttttt<br>actcttccaccatgtataaacattgatatcttcaaatcttcacgacataactttacagagctcctcgacctatcatccaaag<br>gaatagttattcccaatacagtcgaaccctcaaatgaacctcaactccttcttgaaggctccgtcgaaagaagtagtgatgaaggcttggccaacaaatgaaag<br>caagatccatgacgcacacttcaacaagaagattggctaacactggctaacgagaacccgtgacgtaaaggtactacgttgttcgtcaacctcggttgtcttgttcttgtatcagagg<br>taacgtaccactcccaattgaactactggctacgactgaatctcttgatgatcaagaacatgtcttggtgtgtcgggatctgacgggta<br>caacgaattgtattgaattgatcaagaacatgtcttggtgtgtacagaacatgcagaacatcagtcttggaccagactgagaactcttggacactgagaactcttggaccactgagaactcttggaccactgagaactcttggaccactgagaatcaagcagtcatgtgataa<br>aatggatgagatttatctccacaattgaagaagaagtttatgaaagttggcaaccagaaggctaaacaggaagaacaaaccagaaggctaaaatttatatcacaataaattccacatagttcatcattccccaactccc<br>aagtaaataagtatttgttatatataacaaaagtaaggatcaacccatcatcgcaaatacacgtgatcaccctccagctccccagctcgatgttgatccatccccaactccc<br>acatacacagaaagggcatcagcaagggaggtgggggtagagagaagttgatggatgatatgattaaggcgatgcggggcagagactaccctgcagggtaccaagaagaagaagaagataaggaag<br>cgtgtcgtcgagacgagactgcacccgggttcttgatattcgggcgcaggaagttgctgatatccgcagaagttgctgatactccgggaccatgcagtagtcttcg<br>tcgccgggtggtgactacgaacgcacgtggaggcgtggaaggctgcgtgaagagtcgttgaaggtgaaggtcagtgaagtgctgtcgggagaaagggg<br>cgtgtcgatgtggcggagtgtcgagtagagaaggagggtttcagggttgatgatcatcatcatcagcgcctggtgggatgatagagaccgtgagcgatgcgtgggccagcagta<br>catccgcagcggacatgggggtagagacggtctgactggttaccgatggtgtctgtccacctagcagcatcagaagtaaaagaccagccagcatcatgagggaggagaagatacagg<br>gatgctgatgaggtggtctgagtgcatctggaagacaatgtctagtagaatactcctgtgttgactactactattcagacactcttcttggtcttcg<br>aagttgctgcagtttagtctccattgctgcagttgaaaaccaatcagtatgagatgtgaggatgtgttagtgcgtacacgcgccaa<br>accaccgcactctgccccttgccctgctcatcgcatcgaagttcctgaaggtactagcagcagctctcttgcaccctgaggaatgtcaacacctagaggctgtcacccgtcatgtgataa<br>cacagagaatgtatgaaccaatggtgtgtctggtgcaacagacatgatcctggtgtaccaggcaacaagagtcttggaagactctgaacacagagactctgaacaagcatgactagactctgaacacagagactcatgatggactcatgata<br>aattaacaccatttcaacattctgaattcctcaaaactactgaggcatcactcactcttggtcacaagaaacttgtcggaattccactaaaacatcacactcattaccttactc<br>aagtaaataagtatttgttatatataacaaaagtaaggaatcaaccatcatcagaaaatacacatccccatcccaggctcgatgttcatccccagacccgtacccg<br>aagaaaaaaaaaagtgaaaaaaagtttacacaagtcaacccatcatcagaaaatattaattggacttgaagctgaaccaaatgacccgg<br>aatattggttgaaattgaaatgattaacaggcatatacagttccaatcaatagctgtactaaatgactactactattctaatcatgaatatacata<br>gacaaagtgcagccaagagtagaaatcactcccaatcactaaaaatcactcaaaaaatattcactgaatatacataaatgttcactactcttctggtatct<br>cgtcaaataacatatttgaacttccagattaaccattctctccggatatctcctactttggaacattctggaacttcagccattctactgagaa<br>caccaacataaataattgaatttctccactagtcagcatttcctccaggatattactccactaatactcttgaacagaaacattctacatccataaacacgcttacc<br>ggcataaacattaacttcctcaactggctaatccactactgaggcatttctccaatcaagtgaccaccattcaaatcataatgaacaagcaagtcaatcacgctatcttggt<br>aacattaaccatttcaactcagtctgtgaacttctcaacaactgagctgctaaattgcctctccatcagcttcttctggctctcggcttcaatgaactctgtaaaaacctccagtttgttgttcaat<br>aattgaaattagatctcaactgtgaactggcaaccagtcagaaccaagtatactctcctcctggcttcgctaaaatggcctaataactcccaacagcaagtaatgttgtcttcacttaatgagga<br>agaagaatgggtaataacggagagtaaggtggacattgttgactttcataagaattcgaatgaaactcggaactcggtacgatggtcgtgtgaagcaataataaagcat | |

TABLE 20-continued

| Plasmid | Nucleic acid sequence | SEQ ID NO |
|---|---|---|
| | cggcaatgtgaatttctacgggtgacttactgacttcaaatccagcaatagata<br>agaaaattgctagaaacaggacctgaaattccaaatggtctcaataacgtccaaatggtcttcaaaatacttttagtttctcatcagggcaaatccaaagct<br>tcaattcaatacagatcaagttgtctcttcaaaacattggcaaatgctaatgtttcatcagagtagaggcaaattgatttcaagatgatgccgtggtata<br>tttcaagtttgatttcagaaatatcaaaattcaacatgaacacaatctgtcttcagaagtaaaacaatcttagttttaacaattctagcaaaatgatgagtgatca<br>aatggacctttagttaagtcaacacctcagattaagtatttaatgtattctaaaatcaaatcaatgccaagagcatctgatatcttcttaaaagtaccatcgtca<br>cctcaccgtattcagcaaatttctcaactcttttcttcaaaattccaactcttcccaatcttctaccaatcagtgaaatcttcataagcattaacctaccaaaaacaca<br>gtatatttcaaagtacctcagtatatctccaagtgtcagctcttcagtcaaccaagtgaaatcgtcagcattagtggttcaccttcaccataaagtgcaactaaagaaaac<br>caagatatctcagtaatatctccgaatctcaagtgtctgttggatccaaataataacgtatttttatgtctctctcaagctgtgaatacatattcctttgaattccaactccactatcagtattaaggaac<br>taatctctcgtctgtctgttgggatccaaataataacgtatttttatgtctctctcaagctgtgaatacatctcctttgaattaacatcactactactcctattcctactgacttgag<br>ccggtactctgtgtggtcaagcaatagcttgcaaaataagctgcaatgctatcaactaaatacataacatcaacatatgccagcttgag<br>cgatgaaacaatagtcttagtgatgagcagtaagacagtcaagaaagaataaaaaaatgaaattg<br>aaatgttaaaatctttttttatttttctcgtcagtcgttgaagtgtcgatgaatgtcaggcaatgtaccaactagaccaaattctatcctctattattgatgtcattacgggaccaagtctatatata<br>actgtccttctacgtactgggaccttactgactttgaaacatgttcatctgcacagtcaatgtatcatttcgacagtcaggcaatgtaccaactagaccaaattctactactaagacgatttatcactcaagacgtagagacaaagcagtgcta<br>caccgaccccaccgctaccacaccattctttttgggggtttatctcagctcaaagggtatcagtcagctcgaagaatacgactgaatgtccaagcttctcgcttctgaacca<br>tcgctcgcccggtcgtcggcgagcggtatcagtcaagtctcttaagctctatcttaggtgatccttgaaggtgacaaattacttgactgaatacatc<br>cgctgcgtgaaagaacgacccaaggctatcttaagctcttaagctctatcttagtgacaccggtggtgtatcttaaggtgatccttggtcactgcactggatagtgtgtgtc<br>gaagccattgaccaatgtgaccaagcttgtggtggttacctgctgtctccacggtttaagctgctaaaggccgcaagaccagagtccgcttctgggaagt<br>gacaacaatgtcttggcatgacagtgttggtaagccaatgtgcaagcaattgtcaagactgtgcaagaccgcaagacgtcagaggtccacgccttctgaacca<br>ttgaaggactacactggttccaacagtccaagtgtttgaactctgcactctgcgcgatcaagactgttcactctccaagtgaaaccaccactgaagttgcatcatcagattg<br>tcccagaagtgcttctattgtcaagaaggaattctccatctgacctgaattgttcactcaccctccggtatagctcctggctgtgcccggtgtcttgactagtgaagtgtcttgcttgacctt<br>agaagaattgcttgactgcctctaggaccatcaggcctccatactcaggacaccgcgcaaattgcaattgcaaatgtcgaacccaagtgttcacctcacccctccacccat<br>caagcgtgcctccaccaagcgcattctgcttggccctgcaaatcaagtgtgacaaatgctgacaatctatgagaacttgacttgcaagtgcagaaccaatcaagtcctacagctcctagtcccaccat<br>ccgacatgatgtcaatctgtattggccatgtgaacgaccaacctgacaagagaagattgaaagtcgatgacagtcgcaaggctgactgttatacgtgcaagtcctta<br>tctgatgctttggaagccatgtgaacagaccaacctgacaagagaagattgaaagtcgatgaaagtgctatctgtcaagaagctcggcgtaatc<br>atggctagtgtcctgtgtgaaatgttaccgctgaaatgtatcgccaccttatttgtatcccagtcggcgcagctgcgcagtccgggaatgctccaatgagtgagcta<br>actcacttatttgtctgctccgttctccagtcgggcaatgtcaccactactcgagagagagccaccgcgggaatgatccagcagcagcgcggaatggcggtttgcgatt<br>ggggctcttccgttctccgctcactgactcgctgcgctcgggtcgttcggctggcggaccggaagcagccaaaagtaatagtggagaggcggtttgcgtatttctcaa<br>ggggataacgcaggaaagaacatgtgagcaaaaggccagcaaaaggccaggaaccgtaaaaaggccgcgttgctggcgtt | |
| pAA918 | ggccgcagcactaggtttgataatttggtcttctacagttcttcatgtatttcctttcttttagatacttttttttattattcctattgatgtaacgacagtcccactataa<br>ttaacttaaaccttgctctgtaaatcagatgacaagtgttcctgtttgcaggggagctctactagttctcttaattcatcctggttatgttctctgccacgccaaggaatagctg<br>ggccgcaatccaggccacgcaacactatcgctgcccggaaaaatacaaactgtaactcagcagagttaaaccaaagggataaggtataccaagttaaagaa<br>tcttcggaaaaacctcacctctctctcctctgtccaaaatactccctcatcctcacatcaagtgtaagagcagcccaaagtcagcgcctaccacctta<br>cagagatgaattccacactacaccctctcttgccgtcagtcttctgcgtctcgttcacctgggacacccctgggcgacaaccctgcgtcccacactta<br>atcgccttgcacacagattctccttcgccaagtggctcagtgtctgcaagccattgctcgcagtctcggtggcaatcggtgagatccgcagcgcccgtaaccggt<br>gatgcggttttctcctagcctgccagctgccacacatgccgcggcgcagcgtcagacaaccctgcttctctcttggtcagctgccgggtaagcgaactgcgtcagc<br>aacaccgcggagacgcgagaaagggccaaagggccagcgaagaaaaggccaccctagcagttcctcctgtagaggtccgcaaaaactacgcgtatcctaagcgaaatcacgagggtacagcttcagcggt<br>gcggaaccccttcgtgtatttcttattccggcaccaggctcagctactcccccctctgtaactaagaaagatcctaattttcaccagtgagacggcaagacgcttt<br>tcaaatccgtgcgccttatttccgcctttatcccgcctgtcgaaggctctcccgaagctgaaactcaagagctctcccgaaagtctgcgggacactgcacg<br>agtgggttacatcgaactggatctcaacacgctaagtgtggggtcgcgccatacactacctctggagtcaacaacgcgagttcgcgacaaacatccacagagtgatcgctgttgcaagttctcgagg<br>tattatcccggttatgcagtgcgcaagcagtgcagctgcatcctgccgctcctctccacctcctccaactattctgcgagagctccctggaactggcggaacgatcttacggatg<br>gcattgcaacacggggatcactgaactacctactactactcagctgctaatatgctctctgtggggactggacctgaagttgcaggacccacgctt<br>gcattgcaacaacggggatcatgtaactgctgcataatactactcggaacctgctaatatgctctctgtgggggactggacctgaagttgcaggacccacgctt<br>tttgcaacaacggggatcatgtaactgctgcataatactactcggaacctgctaatatgaagacatggcagacccccacgcttgcacccgtagc<br>gcaacacccctatttgtttattctcatacatttaacgggtaaagaggaaaatgtcccaactagttccaggaccatatcaagtcagggaggaggcgaccttgccttcaagccactcggc<br>gtcggccccttccgctgcgggtttattcttctcctgctctgactctgtttggagaagctgagctacttggctgctgcaccccctccccaa<br>cgtagtatctcaccgcggggagtcggcgaactgctccggcaacatatgtactactcaaatatcgagaacgaacaatacagtcgcgattaagctgttgtaacctgtagacagaa | 128 |

TABLE 20-continued

| Plasmid | Nucleic acid sequence | SEQ ID NO |
|---|---|---|
| | gttactcatatactttgattgatttaaaacttcattttaatttaaaaggatctaggtgaagatcctttttgatatcctcatgaccaaaatcccttaacgtgagtttcgttcc actgagcgtcagaccccgtagaaaagatcaaagatcttcttgagatcctttttttctgcgcgtaatctgctgcttgcaaacaaaaaaaccaccgctaccagcggtgg tttgtttgccggatcaagagctaccaactctttttccgaaggtaactggcttcagcagagcgcagataccaaatactgtccttctagtgtagccgtagttaggccaccact tcaagaactctgtagcaccgcctacatacctcgctctgctaatcctgttaccagtggctgctgccagtggcgataagtcgtgtcttaccgggttggactcaagacgata gtaccggataaggcgcagcggtcgggctgaacggggggttcgtgcacacagcccagcttggagcgaacgacctacaccgaactgagatacctacagcgtga gctatgagaaagcgccacgcttcccgaagggagaaaggcggacaggtatccggtaagcggcagggtcggaacaggagagcgcacgagggagcttccagg gggaaacgcctggtatctttatagtcctgtcgggtttcgccacctctgacttgagcgtcgatttttgtgatgctcgtcaggggggcggagcctatggaaaaacgccagc aacgcggcctttttacggttcctggccttttgctggccttttgctcacatgttctttcctgcgttatcccctgattctgtggataaccgtattaccgcctttgagtgagctgataac cgctcgccgcagccgaacgaccgagcgcagcgagtcagtgagcgaggaagcggaagagcgcccaatacgcaaaccgcctctccccgcgcgttggccgattca ttaatgcagctggcacgacaggtttcccgactggaaagcgggcagtgagcgcaacgcaattaatgtgagttagctcactcattaggcaccccaggctttacactttat gcttccgctcgtatgttgtgtggaattgtgagcggataacaatttcacacaggaaacagctatgaccatgattacgccaagctttaattaaagataatcacaggt agagaccttggtatgggctgattggaagaaaatgggtgattggcacttgacagcgcgagagtggttaacaaaaaaatacgaatacctggttccctcattggttctgacattgata agttgaaagaacaatgcagaattcacatggctcgttccccgcccatgctccgcaccgtgtgccccaccatgtttgtgcttgcgttcccgatgcgggtcaccatgacgatggagagcttcgtgaggggccgatatcgagattcgagattcacgacaattatatatatcgtacacagtctagaaaactgcc gggggaaagtaccaagagtgtgatgattaacggtctacgatcgtatcgcgggctacagatcggagcaagtgacatgaggataggagtgctaccgaagcctataaatt catatatatacaaccgcctacgacaattccgccagacccgccacatcaagaaaaaaatggaataacgagaaccatatgccgaatttgccgaaaatatcagacgtgaattatatgtatgaaacgtagaatacgagatatcgttagatccgccagcgatccaaggatccgatcaatattatagccgccacactcattatccatgttttgccggaaaacagggaccctcagcaacatcgtactctgctcgcaacccgaccgatatgagggaagtcgtgttaggaaatcgtgttgcttgttggcgagttctaactggataaagaccatgcaaacggtggctggtggggtcgctgcttgctctatataacggctagcataggtcggtgaccatcaattgtatataactactactttttat taccacttattcattcatacactacaagctctcaggaccgtcatttagtcttcgaagttctccatgaggaaaccaatacgcaatgatggatgtagcagg gatggttagtgcgttcctcgaacaaacccagagtacgcggcagtgcaagtacgcgcctcacattgcccttgcttcatccgcatcacttgaaggtatccacgtacgcagt tgtaatacacctgaagaacgctctcgcacggtacaacggaattgtatgaattgatcaagaacatgatcttggtttacagaacatcaagttcttggaccag actgagaatgcacagatatacaaggcgtcatgtgataaatggaagaagttatcacaatggaaacaaagtttatgaaaagtggtcaaccagaagctaaacag gaagagcaaacgaagggtgaaacaagaagagaagaagatgtataaaggagaaatagtataggaataactaaggaatatatacagatttatatcatgccat acaagtcgagatatctcatccatccccaacctgacggtgacgatcaacaaaacacacgcccgagttcattgctcgctcgacaagctccggtcgccactgttgagcagt caaaccccagttcaattgccaatgttagcacaaaaccgcgttgtgtctcggctgagcggtcgctgcttgcttgcctgctgacaccccagttgcggacaccacttctgctcttgcctgtcgctacgaactattctcgacaattgcatcgcttcttcgagaacactgctcccagtgccaacgttgctgctcaagttctgactggcttggtttatgggagcgcacacatcgaagaacatgcttgtgaagacatttatcttcattatatttcaccagtctacgaagctacgaattatgccataaggcttgtagcgtacgagttgacttcgagcagtctggggctcagt aaaaagaccaacctctgcgctcgatcgacctgacggcacagtagacccgtgttgcttggacgaccaacaccgccggctccttcgtgcgtcgacaagacgcacatcg atatcatctcagacttcagtacacctgcgaggggcacagatacctgagcgtcggggagcggccaaccgcacgaacccgcacgagggttgctgatatcggaaaa acgcggtgaggggtgcataagaaaagaagaaggcggtgttgttgtcggcagcgttcaacaaagtgcgcaagggtcgcggaagcgccgtgagactga gagattgcgaggtgatcggagtcggagtcgttcgtaaggtgtcatcgcgcagcagatgtggtcagctagcgatatggaggtgttgatcgatcatgacgcctgtgtg gtgatggatgataagcgatgcgttgggcagcagtatacaggtgaagaacttgaatacagttagttaaaataagtccatgaatattgtaatagggtata aagagaccgagttggagggaaagaactacaggtgcatgaggcataatctaaccgaatgactgaaaccgtctgatgtttacaaccatgaaccatcaagttggtctagctgt tacataactagtcttcttaggcattcatgatgcccagcaatgcaaaccaatcaaaccgtcaacgatgtttcatgatttttgaaaccaatcaaccaatcaatgatttgcggttta gtgcgttcctgacaaaccagagtacgccgcgctcacaaccgtcacaaatttcatccgcatcgcccttgcttcatcgcatggtgctgatgtagcaggatggtta cttgaagaacggcttcgtctgc | |

375 376

Example 28: Nucleic Acid Sequences of Oligonucleotides Referenced Herein

TABLE 21

| Oligo-nucleotide No. | Nucleic acid sequence | SEQ ID NO |
|---|---|---|
| oAA0124 | CACACACATATGCGACGGGTACAACGAGAATT | 129 |
| oAA0125 | CACACAACGCGTAGACGAAGCCGTTCTTCAAG | 130 |
| oAA0173 | ATGATCTGCCATGCCGAACTC | 131 |
| oAA0174 | AGCGAGTTCGGCATGGCAGATCATCATG | 132 |
| oAA0570 | CACACAGCTCTTCTAGAATGGCTTTAGACAAGTTAGA | 133 |
| oAA0571 | CACACAGCTCTTCGTTTCCAAACATCTTCTTGGTATCTATTTT | 134 |
| oAA0208 | CACACACTGCAGGAGCTCCAATTGTAATAT | 135 |
| oAA0209 | CACACATCTAGACCCGGGCTCTTCTTATGTCGTGAAGATTTGAACAAT | 136 |
| oAA0216 | GAGCCCGGGTCTAGATGTGTGCTCTTCCGAGTGACTCTTTTGATAA | 137 |
| oAA0217 | CACACACATATGGTCGACCTAAATTCGCAACTATCAA | 138 |
| oAA0519 | CACACAGCTCTTCCATAATGACTGCACAGGATATTATCGCC | 139 |
| oAA0520 | CACACAGCTCTTCCCTCTCTTCTATTCCTAATACATCTCAATGTTGGCACCG | 140 |
| oAA0572 | CACACAGCTCTTCCATAATGGCTTTAGACAAGTTAGATTTGT | 141 |
| oAA0573 | CACACAGCTCTTCCCTCTCTTCTATTCCTACCAAACATCTTCTTGGT | 142 |
| oAA2206 | TTCCGCTTAATGGAGTCCAAA | 143 |
| oAA2207 | ATGATCTGCCATGCCGAACTAGACGAAGCCGTTCTTCAAG | 144 |
| oAA2208 | CTTGAAGAACGGCTTCGTCTAGTTCGGCATGGCAGATCAT | 145 |
| oAA2209 | TAAACGTTGGGCAACCTTGG | 146 |
| oAA7409 | AAAATCAGAGGCTACTCCGGAGATGGCACATTATCACGTG | 147 |
| oAA7410 | TGTTGGTGGATGTGGCAGGGGTGGGGGTTGTATGGGTGGTA | 148 |
| oAA7403 | CCGGTTCGTCGCTTGATCCAAAATCAGAGGCTACTCCGGAGATGGCACATTATCACGTG | 149 |
| oAA7404 | CGTCGTCCATTGTTGGTGGATGTGGCAGGGGTGGGGTTGTATGGGTGGTA | 150 |
| oAA7381 | AGAGTCACTCTTATATAACTTTGTCCAAGAACTTTCTGGCC | 151 |
| oAA7382 | CACCAACAATGGACGACGTTGATTCTG | 152 |
| oAA7379 | ACTGGCGGCCGCACGCGTCCAAGGTCGACCTAAATTCGCAAC | 153 |
| oAA7380 | AAGTTATATAAGAGTGACTCTTTTGATAAGAG | 154 |
| oAA7377 | CTTGGACGCGTGCGGCCG | 155 |
| oAA7378 | GGATCAAGCGACGAACCG | 156 |
| oAA2586 | CACACAGCTCTTCCATAATGTTTAACTTTAAGTTGTCGCAACA | 157 |
| oAA2587 | CACACAGCTCTTCCCTCTCTTCTATTCTTACAACTTAGGCTTAGCATCAGTCA | 158 |
| oAA2372 | CCACCAAATCCATTATGCCA | 159 |
| oAA2373 | CCGAAACAACCGTAGATACCTTTAATGGGTTACCCTTGATGACTTCTG | 160 |
| oAA2374 | CAGAAGTCATCAAGGGTAACCCATTAAAGGTATCTACGGTTGTTTCGG | 161 |
| oAA2375 | GATTTCTTCGTCGTGGGCAGGGTACCGAGCTCTGCGAATT | 162 |

TABLE 21-continued

| Oligo-nucleotide No. | Nucleic acid sequence | SEQ ID NO |
|---|---|---|
| oAA2376 | AATTCGCAGAGCTCGGTACCCTGCCCACGACGAAGAAATC | 163 |
| oAA2377 | AGTAAGCCAAACCGAAACCG | 164 |
| oAA3312 | AATTCGCAGAGCTCGGTACCCAACAAGTTGTTGTAGGCACTCAA | 165 |
| oAA3313 | TTGAGTGCCTACAACAACTTGTTGGGTACCGAGCTCTGCGAATT | 166 |
| oAA3314 | GACGAAGAATTCCAAAGGCTTGTTAAAGGTATCTACGGTTGTTTCGG | 167 |
| oAA3315 | CCGAAACAACCGTAGATACCTTTAACAAGCCTTTGGAATTCTTCGTC | 168 |
| oAA4719 | AAAGAAAGAAAGAAACTATAACAATCAATCATGCCAATTTTGAAAAAACCATTC | 169 |
| oAA4720 | TCTTATCAAAAGAGTCACTCTCTTCTATTCTTACAACTTAGGCTTAGCATCAG | 170 |
| oAA4722 | GAATAGAAGAGAGTGACTCTTTTG | 171 |
| oAA4723 | GATTGATTGTTATAGTTTCTTTCTTTC | 172 |
| oAA5319 | TTGACTGATGCTAAGTAAGAATAGAAGAGAGTGACTCTTTTG | 173 |
| oAA5320 | TCTCTTCTATTCTTACTTAGCATCAGTCAATAATCCCTTAG | 174 |
| oAA6472 | AAAAGAAAGAAAGAAACTATAACAATCAATCAATGTTTAACTTTAAGTTGTCGCAACA | 175 |
| oAA6473 | TCAAAAGAGTCACTCTCTTCTATTCTTACTTAGCATCAGTCAATAATCCCTTAGTC | 176 |
| oAA6367 | GAATAGAAGAGAGTGACTCTTTTGATAAGAGTC | 177 |
| oAA6368 | TGATTGATTGTTATAGTTTCTTTCTTTCTTTTG | 178 |
| oAA9946 | AAAGAAAGAAAGAAACTATAACAATCAATCATGTCAACTTACCAGTTCCAAG | 179 |
| oAA9947 | TCTTATCAAAAGAGTCACTCTCTTCTATTCCTAATACTCGCTTAATCTCAAC | 180 |
| oAA6669 | TGATTGATTGTTATAGTTTCTTTCTTTCTTTTG | 181 |
| oAA6771 | TCAACTTACCAGTTCCAAGAAACTTTAGAA | 182 |
| oAA6772 | CAAAAGAAAGAAAGAAACTATAACAATCAATCAATGCTTTCCCGTACCACTTTAAGAGT | 183 |
| oAA6773 | TTCTAAAGTTTCTTGGAACTGGTAAGTTGATTGGTCGGTCTTGCTGTTGAA | 184 |
| oAA6774 | CAAAAGAAAGAAAGAAACTATAACAATCAATCAATGTCTGCATTAAGATCATTCCAACG | 185 |
| oAA6775 | TTCTAAAGTTTCTTGGAACTGGTAAGTTGAATAGGTTCTGACTGAGTTCTTTAAGGTGG | 186 |
| oAA6776 | CAAAAGAAAGAAAGAAACTATAACAATCAATCAATGTTTAACTTTAAGTTGTCGCAACA | 187 |
| oAA6777 | TTCTAAAGTTTCTTGGAACTGGTAAGTTGAACCCTTTGCGTGGCTGGT | 188 |
| oAA5511 | ATGGACGACGTTGATTCTGCTTTAGCCGATAATGTT | 189 |
| oAA5512 | TTATATAACTTTGTCCAAGAACTTTCTGGCC | 190 |
| oAA5553 | TTGTTTCTTTGACACATTGC | 191 |
| oAA5554 | TGCTATTACCACTGCTGG | 192 |
| oAA5555 | CAATGTGTCAAAGAAACAAGGTACCGAGCTCTGCGAA | 193 |
| oAA5556 | CAGCAGTGGTAATAGCATTAAAGGTATCTACGGTTGTTTCG | 194 |
| oAA5698 | GTAACCCCAGAAGGAAAC | 195 |
| oAA5699 | TTCAAGGGTACTGTGGCTAC | 196 |
| oAA5700 | GTTTGCTGTTTCCTTCTGGGGTTACGACGGGTACAACGAGAATTGTATTG | 197 |

TABLE 21-continued

| Oligo-nucleotide No. | Nucleic acid sequence | SEQ ID NO |
|---|---|---|
| oAA5701 | CCAAAGTAGCCACAGTACCCTTGAATGCGAATTGAGCTGGGGG | 198 |
| oAA7624 | AGATCATCATGCCTGCAGAAAATCAGAGGCTACTCC | 199 |
| oAA7625 | GTCACTCTCTTCTATTCTTATATAACTTTGTCCAAGAACTTTC | 200 |
| oAA7512 | GAATAGAAGAGAGTGACTCTTTTG | 201 |
| oAA7265 | CTGCAGGCATGATGATCTG | 202 |
| oAA6369 | AAAAGAAAGAAAGAAACTATAACAATCAATCAATGGCTCCATACCTCAAAAAATTGAGA | 203 |
| oAA6370 | AGAGTCACTCTCTTCTATTCCTACAACTTGGCCCGTCTACCTTTGTTCAACTTCATGGT | 204 |
| oAA0784 | CACACAGCTCTTCCATAATGAGATGCCAAGTATCTCAACCATCAAG | 205 |
| oAA0785 | CACACAGCTCTTCCCTCTCTTCTATTCCTAGTTCAATGATTTAAGGAACTTTTCC | 206 |
| oAA0347 | CACACACTGCAGTTGTCCAATGTAATAATTTT | 207 |
| oAA0348 | CACACATCTAGACCCGGGCTCTTCTTCTGAATAGGCAATTGATAAACTTACTTATC | 208 |
| oAA0351 | GAGCCCGGGTCTAGATGTGTGCTCTTCCAAAGTACGGTGTTGTTGACA | 209 |
| oAA0352 | CACACACATATGAATTCTGTACTGGTAGAGCTAAATT | 210 |
| oAA5668 | GCTGCCAGTGTTGGTGACGACT | 211 |
| oAA5669 | TTGGACGGCGTTGTATCTGGAA | 212 |
| oAA5670 | GCTGTTTCTGACTTGTCGTTTGT | 213 |
| oAA5671 | TGCAGCATGCTTCATAGTGGTC | 214 |
| oAA5672 | GCTTTTGTTGTTGATTCCAAGAG | 215 |
| oAA5673 | CAAGTCAGAAACAGATGCAGCA | 216 |
| oAA5690 | GCTGTTTCTGACTTGGCTTTTGTTGTTGATTCCAAGAGCGAATCCACTTCCAGA | 217 |
| oAA5691 | TGCAGCATGCTTCATAGTGGTC | 218 |
| oAA6145 | TTCAAGTTGGCTCAAATCGCAGGTGCCAGATACAACGCCGTCCAATCTGC | 219 |
| oAA6146 | GCAGATTGGACGGCGTTGTATCTGGCACCTGCGATTTGAGCCAACTTGAA | 220 |
| oAA6691 | GGTGCTCGCTCATTGGCTGATGGTGGCTTGTTG | 221 |
| oAA6692 | CAACAAGCCACCATCAGCCAATGAGCGAGCACC | 222 |
| oAA7257 | CTCTACGCGTTGTACTGGTAGAGCTAAATTGTA | 223 |
| oAA7258 | CATCATGCCTGCAGGTCGACT | 224 |
| oAA7259 | TCATGACTTTCCTGTTCTATCTCTCCCC | 225 |
| oAA7260 | CCATGCTCGAGAGTGCTCCGAAAA | 226 |
| oAA6371 | AAAAGAAAGAAAGAAACTATAACAATCAATCAATGCCAGAATCAACTCAACAATCTC | 227 |
| oAA6372 | GACTCTTATCAAAAGAGTCACTCTCTTCTATTCTTATTTCTTGCAGGCATGGACA | 228 |
| oAA6470 | AAAAGAAAGAAAGAAACTATAACAATCAATCAATGACTACAGACTCAAACACCCACA | 229 |
| oAA6471 | GACTCTTATCAAAAGAGTCACTCTCTTCTATTCTTACTTTCTACCGAATTGAGCACC | 230 |

TABLE 21-continued

| Oligo-nucleotide No. | Nucleic acid sequence | SEQ ID NO |
|---|---|---|
| oAA3582 | ATGCTTACACTAACTTCTGGTCCCAACC | 231 |
| oAA3583 | GACTATTGTCTCTAGCGGTCTAGATCCT | 232 |
| oAA3584 | CACATCGAGCCATGATTGAGAAC | 233 |
| oAA3585 | CGTGAGCAAACAATTGGAACG | 234 |
| oAA3586 | ATGAGTCACCCAACGCCAGA | 235 |
| oAA3587 | TCAGAGCTTCGGCGACTCAG | 236 |
| oAA3588 | ACCATGACGCTGATTGCACC | 237 |
| oAA3589 | CGAGCTACAATTTCTGCACACCT | 238 |
| oAA3590 | ATGCCCACATTCAACTACAAGGAC | 239 |
| oAA3591 | CGCTCTGTTGCAAGTATCGTCA | 240 |
| oAA3592 | ATGTCAACCACCGGAATCTACAAC | 241 |
| oAA3593 | CTACAACTTTGGAGTTGTGACCTGCTTC | 242 |
| oAA3594 | CAGACCCCGAATAATGGACAAA | 243 |
| oAA3595 | CCTCTCTATAATTTCGGGGTGATCAC | 244 |
| oAA3596 | GATCATGGAGAGATTACAGGCCG | 245 |
| oAA3597 | CGTTTTCCCCTACAACTTTGGC | 246 |
| oAA6449 | AAAGAAAGAAAGAAACTATAACAATCAATCATGAGTCACCCAACGCCAGAAG | 247 |
| oAA6450 | TCTTATCAAAAGAGTCACTCTCTTCTATTCTTACGACTCAGCTATGTACAACCTC | 248 |
| oAA2127 | CACACAGCTCTTCCATAATGGTCGCCGATTCTTTAGT | 249 |
| oAA2128 | CACACAGCTCTTCCCTCTCTTCTATTCTTAAGTGGCCTTCCACAAGT | 250 |
| oAA3156 | TTGATAGTTGCGAATTTAGGTCGACAACGATATAAACATTAGCATGCCTG | 251 |
| oAA3354 | CATTATGGTGTTCCGGTTATGAATTCGGTTGAATTGTGGAGTAAAAA | 252 |
| oAA3159 | CCCGAAATATTACAATTGGAGCTCAAGGCTATCTTTAAGTCTATTGACGACA | 253 |
| oAA3356 | GTCAGATTTCACGCCTTTACGAATTCATCAGACTTTTCAAATCTTTCTCTTTCG | 254 |
| oAA3157 | CAGGCATGCTAATGTTTATATCGTTGTCGACCTAAATTCGCAACTATCAA | 255 |
| oAA3158 | TGTCGTCAATAGACTTAAAGATAGCCTTGAGCTCCAATTGTAATATTTCGGG | 256 |
| oAA3355 | CATTATGGTGTTCCGGTTAT | 257 |
| oAA3357 | GTCAGATTTCACGCCTTTAC | 258 |
| oAA951 | CCTACTTCCACAGCTTTAATCTACTATCAT | 259 |
| oAA952 | TTTAAGAAAACAACTAAGAGAAGCCAC | 260 |
| oAA3557 | CATTGAAGAGTGTTTTGCCAGAA | 261 |
| oAA3558 | CCGAAACAACCGTAGATACCTTTAAGGCAAAAATGCAATCACTCTGT | 262 |
| oAA3559 | ACAGAGTGATTGCATTTTTGCCTTAAAGGTATCTACGGTTGTTTCGG | 263 |
| oAA3560 | CGAAATATTACAATTGGAGCTCGGTACCGAGCTCTGCGAATT | 264 |
| oAA3561 | AATTCGCAGAGCTCGGTACCGAGCTCCAATTGTAATATTTCG | 265 |
| oAA3562 | CAGTGGCGGCTTTAACCTTCCGCATATGGTCGACCTAAAT | 266 |
| oAA3563 | ATTTAGGTCGACCATATGCGGAAGGTTAAAGCCGCCACTG | 267 |

TABLE 21-continued

| Oligo-nucleotide No. | Nucleic acid sequence | SEQ ID NO |
|---|---|---|
| oAA3564 | GGGTCCACTCGTCATCCAAC | 268 |
| oAA5770 | AAAGAAAGAAAGAAACTATAACAATCAATCATGATTGAACAACTCCTAGAATATTG | 269 |
| oAA5771 | TCTTATCAAAGAGTCACTCTCTTCTATTCCTAGTCAAACTTGACAATAGC | 270 |
| oAA5768 | GAATAGAAGAGAGTGACTCTTTTG | 271 |
| oAA5769 | GATTGATTGTTATAGTTTCTTTCTTTC | 272 |
| oAA2125 | CACACAGCTCTTCCATAATGGTCAACATATCGAAATT | 273 |
| oAA2126 | CACACAGCTCTTCCCTCTCTTCTATTCTTATATTTCAAATACTTTAT | 274 |
| oAA2159 | CACACAGCTCTTCCATAATGACAGTGGAGAATGCAAAA | 275 |
| oAA2162 | CACACAGCTCTTCCCTCTCTTCTATTCCTACTTCTTGGCGACACTCTTCTTTTCATTCTCCTT | 276 |
| oAA2679 | GACGGGTTATAACAAGCAGGACA | 277 |
| oAA2680 | CCGAAACAACCGTAGATACCTTTAATCAAGATCTTCCAGATAATGGTCAA | 278 |
| oAA2681 | TTGACCATTATCTGGAAGATCTTGATTAAAGGTATCTACGGTTGTTTCGG | 279 |
| oAA2682 | CAACAAATAACAAGTTCTTGCCCTTGGTACCGAGCTCTGCGAATT | 280 |
| oAA2683 | AATTCGCAGAGCTCGGTACCAAGGGCAAGAACTTGTTATTTGTTG | 281 |
| oAA2684 | CTTACTAAGAGATGGACGGTTTGAA | 282 |
| oAA2914 | AATTGACGGGTTATAACAAGCAGG | 283 |
| oAA2915 | AATTCGCAGAGCTCGGTACCGGTGATGTACTGGTCTATGTTTTGGAT | 284 |
| oAA2916 | ATCCAAAACATAGACCAGTACATCACCGGTACCGAGCTCTGCGAATT | 285 |
| oAA2917 | GGTCATCGTCATCTATATCAGCAATATTTAAAGGTATCTACGGTTGTTTCGG | 286 |
| oAA2918 | CCGAAACAACCGTAGATACCTTTAAATATTGCTGATATAGATGACGATGACC | 287 |
| oAA2919 | CACCTGGTACATCAACTCTTCCATA | 288 |
| oAA3051 | CACACAGCTCTTCCATAATGTCC | 289 |
| oAA3052 | CACACAGCTCTTCCCTCTCTTCT | 290 |
| oAA3053 | CACACAGCTCTTCCATAATGTCAG | 291 |
| oAA6658 | CACACAGCTCTTCCATCATGTCCGCCAACGAAAACAT | 292 |
| oAA6659 | CACACAGCTCTTCCAGCTCATGATCTAGTCTTGGCCTTAG | 293 |
| oAA6660 | CACACAGCTCTTCCATCATGTCAGCGAAATCTATTCACGAAGCCGACGGTAAGGC | 294 |
| oAA6661 | CACACAGCTCTTCCAGCTCACACGCCTAAAGGAGTAGAAGCTTC | 295 |
| oAA540 | CACACAGCTCTTCCATAATGCCTACCGAACTTCAAAAAGAAAG | 296 |
| oAA541 | CACACAGCTCTTCCCTCTCTTCTATTCTTAACTGGACAAGATTTCAGCAGC | 297 |
| F98G fwd | GTCTTTGACCCACAAGTCGGAACCAGAATCGGTGTCAAC | 298 |
| F98G rev | GTTGACACCGATTCTGGTTCCGACTTGTGGGTCAAAGAC | 299 |
| W429F fwd | GTAAAGCCTACTCCGACTTTGTTGTCCAATGTACCTG | 300 |
| W429F rev | CAGGTACATTGGACAACAAAGTCGGAGTAGGCTTTAC | 301 |
| oAA0179 | GAATTCACATGGCTAATTTGGCCTCGGTTCCACAACGCACTCAGCATTAAAAA | 302 |
| oAA0182 | GAGCTCCCCTGCAAACAGGGAAACACTTGTCATCTGATTT | 303 |

TABLE 21-continued

| Oligo-nucleotide No. | Nucleic acid sequence | SEQ ID NO |
|---|---|---|
| oAA1023 | GATATTATTCCACCTTCCCTTCATT | 304 |
| oAA1024 | CCGTTAAACAAAAATCAGTCTGTAAA | 305 |
| oAA2055 | TGCCATCCTTGGTAGTCAGTTATT | 306 |
| oAA2056 | CCGAAACAACCGTAGATACCTTTAATGGCTTGTCCTTGGTGTTGA | 307 |
| oAA2060 | TGTCGCCATTCAACCAGTAGAT | 308 |
| oAA2069 | AATTCGCAGAGCTCGGTACCGACTTGTTGAAGATGGACGAGGA | 309 |
| oAA2057 | TCAACACCAAGGACAAGCCATTAAAGGTATCTACGGTTGTTTCGG | 310 |
| oAA2068 | TCCTCGTCCATCTTCAACAAGTCGGTACCGAGCTCTGCGAATT | 311 |
| oAA2070 | TTGATCCACTGTCTTAAGATTGTCAA | 312 |
| oAA2075 | AGGATTTTGCTGTTGGTGGC | 313 |
| oAA2074 | AATTCGCAGAGCTCGGTACCATACGTCGGTGAGGTCTGTCG | 314 |
| oAA2072 | ATTCTCCGCTACTTCGTTCTGGTTAAAGGTATCTACGGTTGTTTCGG | 315 |
| oAA2073 | CGACAGACCTCACCGACGTATGGTACCGAGCTCTGCGAATT | 316 |
| oAA2071 | CCGAAACAACCGTAGATACCTTTAACCAGAACGAAGTAGCGGAGAAT | 317 |
| oAA2656 | AAGCTTTTAATTAAAGATAATCACAGGGGTAGAGACCTTG | 318 |
| oAA2657 | GGATCCGCATGCGGCCGGCCGATAGCGTGGTATGAATGAATAAGTGTG | 319 |
| oAA2658 | GGATCCGAGCTCGCGGCCGCGAGCACTAGGTTTTGATAATTTGGTTCTTAC | 320 |
| oAA2659 | GAATTCTTAATTAACGGCGAAGAACATAGTGTGATG | 321 |

Example 29: Transformation Procedure 5 mL YPD start cultures were inoculated with a single colony of *Candida* strain ATCC20913 and incubated overnight at 30° C., with shaking at about 200 rpm. The following day, fresh 25 mL YPD cultures were inoculated to an initial OD600 nm of 0.4 and the culture incubated at 30° C., with shaking at about 200 rpm until an OD600 nm of 1.0-2.0 was reached. Cells were pelleted by centrifugation at 1,000×g, 4° C. for 10 minutes. Cells were washed by resuspending in 10 mL sterile water, pelleted, resuspended in 1 mL sterile water and transferred to a 1.5 mL microcentrifuge tube. The cells were then washed in 1 mL sterile TE/LiOAC solution, pH 7.5, pelleted, resuspended in 0.25 mL TE/LiOAC solution and incubated with shaking at 30° C. for 30 minutes.

The cell solution was divided into 50 μL aliquots in 1.5 mL tubes to which was added 5-8 μg of linearized DNA and 5 μL of carrier DNA (boiled and cooled salmon sperm DNA, 10 mg/mL). 300 μL of sterile PEG solution (40% PEG 3500, 1× TE, 1× LiOAC) was added, mixed thoroughly and incubated at 30° C. for 60 minutes with gentle mixing every 15 minutes. 40 μL of DMSO was added, mixed thoroughly and the cell solution was incubated at 42° C. for 15 minutes. Cells were then pelleted by centrifugation at 1,000×g 30 seconds, resuspended in 500 μL of YPD media and incubated at 30° C. with shaking at about 200 rpm for 2 hours. Cells were then pelleted by centrifugation and resuspended in 1 mL 1× TE, cells were pelleted again, resuspended in 0.2 mL 1× TE and plated on selective media. Plates were incubated at 30° C. for growth of transformants.

Example 30: Construction of Strain sAA7445 for the Production of Lycopene from Glucose In order to integrate genes into the genome of *C. viswanathii*, genes were cloned into a plasmid that allows for single crossover recombination at the URA3 loci. In addition, since glucose was the primary carbon source, all genes were expressed under a GPD promoter with a POX4 terminator. The backbone for all plasmids was PCR amplified from pAA2534 with primers oAA07511 and oAA07512. The CrtE gene from *Cronobacter sakazakii* (CsCrtE) was codon optimized for *C. viswanathii*, synthesized, and then PCR amplified using primers oAA9745 and oAA9746. The CsCrtE PCR product and backbone contained overlapping sequence at their termini allowing directional ligation, generating plasmid pAA2698. The CrtB gene from *Cronobacter sakazakii* (CsCrtB) was codon optimized for *C. viswanathii*, synthesized, and then PCR amplified using primers oAA9749 and oAA9750. The CsCrtB PCR product and backbone contained overlapping sequence at their termini allowing directional ligation, generating plasmid pAA2699. The CrtI gene from *Cronobacter sakazakii* (CsCrtI) was codon optimized for *C. viswanathii*, synthesized, and then PCR amplified using primers oAA9747 and oAA9748. The CsCrtI PCR product and backbone contained overlapping sequence at their termini allowing directional ligation, generating plasmid pAA2700. Integration cassettes containing glucose inducible CsCrtE, CsCrtB, CsCrtI genes were then generated by PCR amplification of plasmids pAA2698, pAA2699, and pAA2700 with primers oAA2206 and oAA2209. All three cassettes were purified and chemically transformed into strain sAA002, which was then plated onto SCD-ura plates. Yellow/red colored colonies were streaked onto YPD for isolation and characterization. Colony PCR was performed to confirm the presence of all three genes, and one verified isolate was saved as strain sAA7445.

Example 31: Shake Flask Characterization of sAA 7445 on Glucose

Starter cultures (5 mL) of sAA7445 in YPD were incubated overnight at 30° C., with shaking at approximately 250 rpm. The overnight cultures were used to inoculate 25 mL fresh SP92-glucose media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glucose) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 µL of glucose was added to the shake flasks, which were shaken at approximately 300 rpm, at 30° C. Cultures were incubated for 48 hours and samples were taken at 48 hours for analysis of carotenoid production by HPLC, and results are presented in Table 22 below.

TABLE 22

| Strain | Substrate | Lycopene (g/L) | B-carotene (g/L) | Astaxanthin (g/L) |
| --- | --- | --- | --- | --- |
| sAA7445 | Glucose | 0.02 | | |
| sAA7882 | Glucose | 0.003 | 0.007 | |
| sAA7870 | Glucose | 0.0015 | 0.001 | 0.0015 |
| sAA7446 | Oleic Acid | 0.001 | | |
| sAA7565 | Oleic Acid | 0.011 | | |
| sAA8283 | Oleic Acid | 0.061 | | |
| sAA8283 | C10-C14 alkanes | 0.008 | | |
| sAA8283 | Methyl pentadecanoate | 0.012 | | |
| sAA8283 | Ethyl laurate | 0.022 | | |
| sAA8283 | CPO | 0.030 | | |
| sAA8283 | Ethyl PFAD | 0.051 | | |
| sAA8283 | Nonane | 0.002 | | |
| sAA8283 | Octadecane | 0.0125 | | |
| sAA8519 | Oleic Acid | 0.002 | 0.007 | |
| sAA8503 | Glucose | 0.035 | | |
| sAA8932 | Glucose | 0.064 | | |
| sAA8932 | Oleic Acid | 0.027 | | |
| sAA9432 | Oleic acid | 0.061 | | |
| sAA9670 | Oleic acid | 0.167 | | |
| sAA9811 | Oleic acid | 0.156 | | |
| sAA9812 | Oleic acid | 0.214 | | |
| sAA9814 | Oleic acid | 0.161 | | |
| sAA9817 | Oleic acid | 0.277 | | |
| sAA9819 | Oleic acid | 0.382 | | |
| sAA9821 | Oleic acid | 0.447 | | |

Example 32: Construction of Strain sAA 7446 for the Production of Lycopene from Oleic Acid In order to integrate genes into the genome of C. viswanathii, genes were cloned into a plasmid that allows for single crossover recombination at the URA3 loci. In addition, since oleic acid was the primary carbon source, all genes were expressed under a HDE1 promoter with a POX4 terminator. The backbone for all plasmids was PCR amplified from pAA1164 with primers oAA5788 and oAA5789. The CrtE gene from Cronobacter sakazakii (CsCrtE) was codon optimized for C. viswanathii, synthesized, and then PCR amplified using primers oAA9753 and oAA9754. The CsCrtE PCR product and backbone contained overlapping sequence at their termini allowing directional ligation, generating plasmid pAA2702. The CrtB gene from Cronobacter sakazakii (CsCrtB) was codon optimized for C. viswanathii, synthesized, and then PCR amplified using primers oAA9757 and oAA9758. The CsCrtB PCR product and backbone contained overlapping sequence at their termini allowing directional ligation, generating plasmid pAA2703. The CrtI gene from Cronobacter sakazakii (CsCrtI) was codon optimized for C. viswanathii, synthesized, and then PCR amplified using primers oAA9755 and oAA9756. The CsCrtI PCR product and backbone contained overlapping sequence at their termini allowing directional ligation, generating plasmid pAA2704. Integration cassettes containing oleic acid inducible CsCrtE, CsCrtB, CsCrtI genes were then generated by PCR amplification of plasmids pAA2702, pAA2703, and pAA2704 with primers oAA2206 and oAA2209. All three cassettes were purified and chemically transformed into strain sAA002; the cells were plated onto SCD-ura plates. Yellow colored colonies were streaked onto YPD for isolation and characterization. Colony PCR was performed to confirm the presence of all three genes, and one verified isolate was saved as strain sAA7446.

Example 33: Shake Flask Characterization of sAA 7446 on Oleic Acid

Starter cultures (5 mL) of sAA7446 in YPD were incubated overnight at 30° C., with shaking at approximately 250 rpm. The overnight cultures were used to inoculate 25 mL fresh SP92-glycerol media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glycerol) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 µL of oleic acid was added to the shake flasks, which were shaken at approximately 300 rpm, at 30° C. Cultures were incubated for 48 hours and samples were taken at 48 hours for analysis of carotenoid production by HPLC, and results are presented in Table 22 above.

Example 34: Construction of Strain sAA 7449 for the Production of Valencene from Glucose In order to integrate genes into the genome of C. viswanathii, genes were cloned into a plasmid that allows for single crossover recombination at the URA3 loci. In addition, since glucose was the primary carbon source, all genes will be expressed under a GPD promoter with a POX4 terminator. The TPS1 Gene from Callitropsis nootkatensis (CnTPS1) was codon optimized for C. viswanathii, synthesized, and then PCR amplified using primers oAA9751 and oAA9752. In addition, the plasmid backbone was PCR amplified from pAA2534 using primers oAA07511 and oAA07512. The CnTPS1 PCR product and backbone contained overlapping sequence at their termini allowing directional ligation, generating plasmid pAA2701. An integration cassette for CnTPS1 was then generated by PCR amplification of the pAA2701 plasmid with primers oAA2206 and oAA2209. The PCR product was purified and chemically transformed into strain sAA002, and plated onto SCD-ura plates. Colonies were streaked onto YPD for isolation and characterization. Colony PCR was performed to confirm the presence of the CnTPS1 gene, and one verified isolate was saved as strain sAA7449.

Example 35: Shake Flask Characterization of sAA 7449 on Glucose

Starter cultures (5 mL) of sAA7449 in YPD were incubated overnight at 30° C., with shaking at approximately 250 rpm. The overnight cultures were used to inoculate 25 mL fresh SP92-glucose media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glucose) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 µL of glucose was added to the shake flasks, in addition to 1.25 mL of n-Decane. The flasks were then incubated at 30° C. and shaken at approximately 300 rpm. Incubation of the cultures continued for 48 hours and samples were taken from the organic layer at 48 hours for analysis of valencene production by GCMS. A Shimadzu GCMS-QP2010SE equipped with AOC-20i auto injector with a 30 m×0.32 mm×0.25 µm Phenomenex ZB-5HT column was used. Retention time and identity of valencene was determined by injection of a standard from Sigma-Aldrich and confirmed by NIST MS Search 2.0 library match. Positive valencene containing samples were matched by their retention times and their mass spectra (FIG. 48A, FIG. 48B).

Example 36: Construction of Strain sAA 7453 for the Production of Valencene from Oleic Acid In order to integrate genes into the genome of *C. viswanathii*, genes were cloned into a plasmid that allows for single crossover recombination at the URA3 loci. In addition, since oleic acid was the primary carbon source, all genes will be expressed under a HDE1 promoter with a POX4 terminator. The TPS1 Gene from *Callitropsis nootkatensis* (CnTPS1) was codon optimized for *C. viswanathii*, synthesized, and then PCR amplified using primers oAA9759 and oAA9760. In addition, the plasmid backbone was PCR amplified from pAA1164 using primers oAA05788 and oAA05789. The CnTPS1 PCR product and backbone contained overlapping sequence at their termini allowing directional ligation, generating plasmid pAA2705. An integration cassette for CnTPS1 was then generated by PCR amplification of the pAA2705 plasmid with primers oAA2206 and oAA2209. The PCR product was purified and chemically transformed into strain sAA002, and plated onto SCD-ura plates. Colonies were streaked onto YPD for isolation and characterization. Colony PCR was performed to confirm the presence of the CnTPS1 gene, and one verified isolate was saved as strain sAA7453.

Example 37: Shake Flask Characterization of sAA 7453 on Oleic Acid

Starter cultures (5 mL) of sAA7453 in YPD were incubated overnight at 30° C., with shaking at approximately 250 rpm. The overnight cultures were used to inoculate 25 mL fresh SP92-glucose media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glucose) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 µL of oleic acid was added to the shake flasks, in addition to 1.25 mL of n-Decane. The flasks were then incubated at 30° C. and shaken at approximately 300 rpm. Incubation of the cultures continued for 48 hours and samples were taken from the organic layer at 48 hours for analysis of valencene production by GCMS. A Shimadzu GCMS-QP2010SE equipped with AOC-20i auto injector with a 30 m×0.32 mm×0.25 µm Phenomenex ZB-5HT column was used. Retention time and identity of valencene was determined by injection of a standard from Sigma-Aldrich and confirmed by NIST MS Search 2.0 library match. Positive valencene containing samples were matched by their retention times and their mass spectra (FIG. 49A, FIG. 49B).

Example 38: Construction of Strain sAA6234

Strain sAA5733 (described in International Patent Application Publication No. WO2016/154046) was placed on 5'FOA for the loop-out of URA3, leaving a URA3 terminator scar. One correct transformant was identified and saved as strain sAA5761. In order to knock out the final copy of CRC1 from the genome, plasmid pAA1701 with 253 bp and 375 bp homology region to the 5' and 3' respectively within the open reading frame of CRC1 in the genome was constructed with a URA3 selection cassette. Plasmid pAA1701 construction details are provided in Example 6 and FIG. 32. CRC1 knockout cassette was amplified from pAA1701 using primers oAA05511 and oAA5512 and the resulting fragment was integrated into the sAA5761 genome with URA selection. Correct crc1/crc1::URA3 transformants were identified and plated onto 5'FOA for the loop-out of URA3, leaving a URA3 promoter scar. One correct transformant was identified and saved as strain sAA6234.

Example 39: Construction of Strain sAA 7565 for the Production of Lycopene from Oleic Acid Plasmid pAA2311 was constructed by PCR amplification of pG6Pl-CRC1 fragment from pAA2214 using primers oAA7624 and oAA7625, and PCR amplification of the plasmid backbone from pAA1116 using primers oAA7512 and oAA7265 (in certain instances, PCR amplification of the plasmid backbone was from pAA1164). The two PCR products encoded overlapping sequence at their termini allowing directional ligation, generating plasmid pAA2311. Integration cassettes for CsCrtE, CsCrtB, CsCrtI, and pG6Pl-CRC1 were then generated by PCR amplification of plasmids pAA2702, pAA2703, pAA2704, and pAA2311 with primers oAA2206 and oAA2209. All four cassettes were purified and chemically transformed into strain sAA6234, which had both copies of CRC1 deleted. The transformed cells were then plated onto SCD-ura plates. Colonies were streaked onto YPD for isolation and characterization. Colony PCR was performed to confirm the presence of all four genes, and one verified isolate was saved as strain sAA7565.

Example 40: Shake Flask Characterization of sAA 7565 on Oleic Acid

Starter cultures (5 mL) of sAA7565 in YPD were incubated overnight at 30° C., with shaking at approximately 250 rpm. The overnight cultures were used to inoculate 25 mL fresh SP92-glycerol media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glycerol) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 µL of oleic acid was added to the shake flasks, which were shaken at approximately 300 rpm, at 30° C. Cultures were incubated for 48 hours and samples were taken at 48 hours for analysis of carotenoid production by HPLC, and results are presented in Table 22 above.

Example 41: Construction of Strain sAA 7882 for the Production of β-Carotene from Glucose In order to integrate genes into the genome of *C. viswanathii*, genes were cloned into a plasmid that allows for single crossover recombination at the URA3 loci. In addition, since glucose was the primary carbon source, all genes were expressed under a GPD promoter with a POX4 terminator. The CrtYB Gene from *Xanthophyllomyces dendrorho* (XdCrtYB) was codon optimized for *C. viswanathii*, and then synthesized with additional flanking regions. The XdCrtYB gene and flanking regions were PCR amplified using primers oAA9958 and oAA9959, while the plasmid backbone was PCR amplified from pAA2534 with primers oAA07511 and oAA07512. The two PCR products encoded overlapping sequence at their termini allowing directional ligation, generating plasmid pAA2866. Integration cassettes for CsCrtE, CsCrtI, and XdCrtYB were then generated by PCR amplification of plasmids pAA2698, pAA2700, and pAA2866 with primers oAA2206 and oAA2209. All three cassettes were purified and chemically transformed into strain sAA002, which was then plated onto SCD-ura plates. Yellow colored colonies were streaked onto YPD for isolation and characterization. Colony PCR was performed to confirm the presence of all three genes, and one verified isolate was saved as strain sAA7882.

Example 42: Shake Flask Characterization of sAA 7882 on Glucose

Starter cultures (5 mL) of sAA7882 in YPD were incubated overnight at 30° C., with shaking at approximately 250 rpm. The overnight cultures were used to inoculate 25 mL fresh SP92-glucose media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glucose) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 µL of glucose was added to the shake flasks, which were shaken at approximately 300 rpm, at 30° C. Incubation of the cultures continued for 48 hours and samples were taken at 48 hours for analysis of carotenoid production by HPLC, and results are presented in Table 22 above.

Example 43: Construction of Strain sAA7870 for the Production of Astaxanthin from Glucose In order to integrate genes into the genome of *C. viswanathii*, genes were cloned into a plasmid that allows for single crossover recombination at the URA3 loci. In addition, since glucose was the primary carbon source, all genes were expressed under a GPD promoter with a POX4 terminator. The backbone for all plasmids was amplified from pAA2534 with primers oAA07511 and oAA07512. The CrtR Gene from *Xanthophyllomyces* dendrorhous (XdCrtR) was codon optimized for *C. viswanathii*, and then synthesized with additional flanking regions. The XdCrtR gene and flanking regions were amplified using primers oAA9960 and oAA9961. The XdCrtR PCR product and the pAA2534 backbone PCR encoded overlapping sequence at their termini allowing directional ligation, generating plasmid pAA2993. The CrtS Gene from *Xanthophyllomyces dendrorho* (XdCrtS) was codon optimized for *C. viswanathii*, and then synthesized with additional flanking regions. The XdCrtS gene and flanking regions were amplified using primers oAA9962 and oAA9963. The XdCrtS PCR product and the pAA2534 backbone PCR encoded overlapping sequence at their termini allowing directional ligation, generating plasmid pAA2994. The CrtW Gene from *Agrobacterium aurantiacum* (AaCrtW) was codon optimized for *C. viswanathii*, and then synthesized with additional flanking regions. The AaCrtW gene and flanking regions were amplified using primers oAA9964 and oAA9965. The AaCrtW PCR product and the pAA2534 backbone PCR encoded overlapping sequence at their termini allowing directional ligation, generating plasmid pAA2995. The CrtZ Gene from *Agrobacterium aurantiacum* (AaCrtZ) was codon optimized for *C. viswanathii*, and then synthesized with additional flanking regions. The AaCrtZ gene and flanking regions were amplified using primers oAA9966 and oAA9967. The AaCrtZ PCR product and the pAA2534 backbone PCR encoded overlapping sequence at their termini allowing directional ligation, generating plasmid pAA2996. Integration cassettes for CsCrtE, CsCrtI, XdCrtYB, XdCrtR, XdCrtS, AaCrtW, and AaCrtZ were then generated by PCR amplification of plasmids pAA2698, pAA2700, pAA2866, pAA2993, pAA2994, pAA2995, and pAA2996 with primers oAA2206 and oAA2209. All seven cassettes were purified and chemically transformed into strain sAA002, which was then plated onto SCD-ura plates. Yellow colored colonies were streaked onto YPD for isolation and characterization. Colony PCR was performed to confirm the presence of all seven genes, and one verified isolate was saved as strain sAA7870.

Example 44: Shake Flask Characterization of sAA7870 on Glucose

Starter cultures (5 mL) of sAA7870 in YPD were incubated overnight at 30° C., with shaking at approximately 250 rpm. The overnight cultures were used to inoculate 25 mL fresh SP92-glucose media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glucose) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 µL of glucose was added to the shake flasks, which were shaken at approximately 300 rpm, at 30° C. Cultures were incubated for 48 hours and samples were taken at 48 hours for analysis of carotenoid production by H PLC, and results are presented in Table 22 above.

Example 45: Construction of Strain sAA8283 for the Production of Lycopene from Oleic Acid Integration cassettes for CsCrtE, CsCrtB, CsCrtI, and pG6Pl-CRC1 were generated by PCR amplification of plasmids pAA2702, pAA2703, pAA2704, and pAA2311 with primers oAA2206 and oAA2209. All four cassettes were purified and chemically transformed into strain sAA4377, which had all copies of FAA1 (Long chain fatty acyl-CoA synthetase), FAT1 (Very long chain fatty acyl-CoA synthetase), CRC1 (Mitochondrial carnitine transporter), and POX4 (Acyl-coenzyme A oxidase) removed. The transformed cells were then plated onto SCD-ura plates. Colonies were streaked onto YPD for isolation and characterization. Colony PCR was performed to confirm the presence of all four genes, and one verified isolate was saved as strain sAA8283.

Example 46: Shake Flask Characterization of sAA8283 on Oleic Acid

Starter cultures (5 mL) of sAA8283 in YPD were incubated overnight at 30° C., with shaking at approximately 250 rpm. The overnight cultures were used to inoculate 25 mL fresh SP92-glycerol media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glycerol) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 µL of oleic acid was added to the shake flasks, which were shaken at approximately 300 rpm, at 30° C. Cultures were incubated for 48 hours and samples were taken at 48 hours for analysis of carotenoid production by HPLC, and results are presented in Table 22 above.

Example 47: Construction of Strain sAA8519 for the Production of β-Carotene from Oleic Acid In order to integrate genes into the genome of C. viswanathii, genes were cloned into a plasmid that allows for single crossover recombination at the URA3 loci. In addition, since oleic acid was the primary carbon source, all genes were expressed under a HDE promoter with a POX4 terminator. The CrtYB Gene from Xanthophyllomyces dendrorho (XdCrtYB) was amplified from pAA2866 using primers oAA9968 and oAA2091, while the plasmid backbone was PCR amplified from pAA2534 with primers oAA07511 and oAA07512. The two PCR products encoded overlapping sequence at their termini allowing directional ligation, generating plasmid pAA3373. Integration cassettes for CsCrtE, XdCrtYB, CsCrtI, and pG6Pl-CRC1 were then generated by PCR amplification of plasmids pAA2702, pAA3373, pAA2704, and pAA2311 with primers oAA2206 and oAA2209. All four cassettes were purified and chemically transformed into strain sAA4377. The transformed cells were then plated onto SCD-ura plates. Colonies were then streaked onto YPD for isolation and characterization. Colony PCR was performed to confirm the presence of all four genes, and one verified isolate was saved as strain sAA8519.

Example 48: Shake Flask Characterization of sAA8519 on Oleic Acid

Starter cultures (5 mL) of sAA8519 in YPD were incubated overnight at 30° C., with shaking at approximately 250 rpm. The overnight cultures were used to inoculate 25 mL fresh SP92-glycerol media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glycerol) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 µL of oleic acid was added to the shake flasks, which were shaken at approximately 300 rpm, at 30° C. Cultures were incubated for 48 hours and samples were taken at 48 hours for analysis of carotenoid production by HPLC, and results are presented in Table 22 above.

Example 49: Shake Flask Characterization of sAA8283 on Various Carbon Sources Starter cultures (5 mL) of sAA8283 in YPD were incubated overnight at 30° C., with shaking at approximately 250 rpm. The overnight cultures were used to inoculate 25 mL fresh SP92-glycerol media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glycerol) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 µL of either C10-C14 mixed alkanes, methyl pentadecanoate, ethyl laurate, crude palm oil (CPO), Ethyl PFAD, nonane, or octadecane was added to the shake flasks, which were shaken at approximately 300 rpm, at 30° C. Cultures with CPO and Ethyl PFAD also contained 0.1% Triton X-100. Cultures were incubated for 48 hours and samples were taken at 48 hours for analysis of carotenoid production by HPLC, and results are presented in Table 22 above.

Example 50: Construction of Strain sAA8503 for Production of Lycopene

In order to integrate genes into the genome of C. viswanathii, genes were cloned into a plasmid that allows for single crossover recombination at the URA3 loci. In addition, since glucose was the primary carbon source, all genes were expressed under a GPD promoter with a POX4 terminator. Integration cassettes for XdCrtE, CsCrtB, and CsCrtI, were generated by PCR amplification of plasmids pAA3189, pAA2699, and pAA2700 with primers oAA2206 and oAA2209. All cassettes were purified and chemically transformed into strain sAA002. The transformed cells were then plated onto SCD-ura plates. Colonies were streaked onto YPD for isolation and characterization. Colony PCR was performed to confirm the presence of all three genes, and one verified isolate was saved as strain sAA8503.

Example 51: Shake Flask Characterization of sAA8503 on Glucose

Starter cultures (5 mL) of sAA8503 in YPD were incubated overnight at 30° C., with shaking at approximately 250 rpm. The overnight cultures were used to inoculate 25 mL fresh SP92-glucose media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glucose) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 μL of glucose was added to the shake flasks, which were shaken at approximately 300 rpm, at 30° C. Cultures were incubated for 48 hours and samples were taken at 48 hours for analysis of carotenoid production by H PLC, and results are presented in Table 22 above.

Example 52: Construction of Strain sAA8932 for Production of Lycopene

In order to integrate genes into the genome of *C. viswanathii*, genes were cloned into a plasmid that allows for single crossover recombination at the URA3 loci. In addition, since glucose was the primary carbon source, all genes were expressed under a GPD promoter with a POX4 terminator. Integration cassettes for XdCrtE, CsCrtB, and XdCrtI, were generated by PCR amplification of plasmids pAA3189, pAA2699, and pAA3490 with primers oAA2206 and oAA2209. All cassettes were purified and chemically transformed into strain sAA002. The transformed cells were then plated onto SCD-ura plates. Colonies were streaked onto YPD for isolation and characterization. Colony PCR was performed to confirm the presence of all three genes, and one verified isolate was saved as strain sAA8932.

Example 53: Shake Flask Characterization of sAA8932 on Glucose

Starter cultures (5 mL) of sAA8932 in YPD were incubated overnight at 30° C., with shaking at approximately 250 rpm. The overnight cultures were used to inoculate 25 mL fresh SP92-glucose media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glucose) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 μL of glucose was added to the shake flasks, which were shaken at approximately 300 rpm, at 30° C. Cultures were incubated for 48 hours and samples were taken at 48 hours for analysis of carotenoid production by H PLC, and results are presented in Table 22 above.

Example 54: Shake Flask Characterization of sAA8932 on Oleic Acid

Starter cultures (5 mL) of sAA8932 in YPD were incubated overnight at 30° C., with shaking at approximately 250 rpm. The overnight cultures were used to inoculate 25 mL fresh SP92-glycerol media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glucose) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 μL of oleic acid was added to the shake flasks, which were shaken at approximately 300 rpm, at 30° C. Cultures were incubated for 48 hours and samples were taken at 48 hours for analysis of carotenoid production by HPLC and results are presented in Table 22 above.

Example 55: Carotenoid Extraction

A 0.5 ml sample of fermentation broth was sampled. Yeast cells were isolated from media by centrifugation and supernatant removal. 0.25 ml of zirconia beads and 1.0 ml of tert-Butyl methyl ether (MTBE) were added to each cell pellet. Pellets were bead-beated with a Biospec Mini-Beadbeater-16 for 1.5 minutes. Cell debris and beads were pelleted by centrifugation and the carotenoid containing MTBE extract was saved. Multiple rounds of bead-beating were conducted until remaining cell pellet was white.

Example 56: Carotenoid Detection

A Thermo Scientific Dionex UltiMate 3000 Liquid Chromatography System with an Acclaim C30 column was used to detect and quantify carotenoids. Column temperature was 20° C., flow rate of 1.0-1.4 mL/min, injection volume of 10 μl, and UV absorbance measured at 474 nm, 450 nm, and 285 nm. Metabolite standards were purchased from Sigma-Aldrich. Samples were diluted in MTBE.

Example 57: Construction of Strain sAA9432 for Production of Lycopene

In order to integrate genes into the genome of *C. viswanathii*, genes were cloned into a plasmid that allows for single crossover recombination at the URA3 loci. In addition, since oleic acid was the primary carbon source, all genes were expressed under a HDE promoter with a POX4 terminator. Integration cassettes for XdCrtE, CsCrtB, and XdCrtI, were generated by PCR amplification of plasmids pAA3633, pAA2703, and pAA3634 with primers oAA2206 and oAA2209. All cassettes were purified and chemically transformed into strain sAA002. The transformed cells were then plated onto SCD-ura plates. Colonies were streaked onto YPD for isolation and characterization. Colony PCR was performed to confirm the presence of all three genes, and one verified isolate was saved as strain sAA9432.

Example 58: Shake Flask Characterization of sAA9432 on Oleic Acid

Starter cultures (5 mL) of sAA9432 in YPD were incubated overnight at 30° C., with shaking at approximately 250 rpm. The overnight cultures were used to inoculate 25 mL fresh SP92-glycerol media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glycerol) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 µL of oleic acid was added to the shake flasks, which were shaken at approximately 300 rpm, at 30° C. Cultures were incubated for 48 hours and samples were taken at 48 hours for analysis of carotenoid production by HPLC, and results are presented in Table 22 above.

Example 59: Construction of sAA9539, Single Copy of RAS2 Knocked-Out

In order to knock out a single copy of RAS2 from the genome, plasmid pVZ3930 with 400 bp homology region to both the 5' and 3' region surrounding RAS2 in the genome was constructed with a URA3 selection cassette. 5' region was amplified with oAA10284 & oVZ0041, 3' region was amplified with oAA10286 & oAA10287, the URA3 cassette digested from pAA408 using restriction enzymes BamHI/PstI, and all pieces were ligated into a pUC19 vector generating pVZ3930. pVZ3930 was then digested with PacI and the resulting fragment was integrated into the sAA002 genome with URA selection. Correct ras2::URA3/RAS2 transformants were identified and plated onto 5'FOA for the loop-out of URA3, leaving a URA3 terminator scar. One correct transformant was identified and saved as strain sAA9539.

Example 60: Construction of Strain sAA9670 for Production of Lycopene

In order to integrate genes into the genome of *C. viswanathii*, genes were cloned into a plasmid that allows for single crossover recombination at the URA3 loci. In addition, since oleic acid was the primary carbon source, all genes were expressed under a HDE promoter with a POX4 terminator. Integration cassettes for XdCrtE, CsCrtB, and XdCrtI, were generated by PCR amplification of plasmids pAA3633, pAA2703, and pAA3634 with primers oAA2206 and oAA2209. All cassettes were purified and chemically transformed into strain sAA9539. The transformed cells were then plated onto SCD-ura plates. Colonies were streaked onto YPD for isolation and characterization. Colony PCR was performed to confirm the presence of all three genes, and one verified isolate was saved as strain sAA9670.

Example 61: Shake Flask Characterization of sAA9670 on Oleic Acid

Starter cultures (5 mL) of sAA9670 in YPD were incubated overnight at 30° C., with shaking at approximately 250 rpm. The overnight cultures were used to inoculate 25 mL fresh SP92-glycerol media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glycerol) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 µL of oleic acid was added to the shake flasks, which were shaken at approximately 300 rpm, at 30° C. Cultures were incubated for 48 hours and samples were taken at 48 hours for analysis of carotenoid production by HPLC, and results are presented in Table 22 above.

Example 62: Construction of sAA9684, Leucine Auxotrophy in sAA002 Background In order to knock out the first copy of Leu2 from the genome, plasmid pAA3060 with a 259 bp and a 256 bp homology region to both the 5' and 3' region, respectively, of the Leu2 gene was constructed with a URA3 selection cassette. The 5' region was amplified with oAA7682 and oAA7683, the 3' region was amplified with oAA7686 and oAA7687, the URA3 cassette was amplified from pAA408 using oAA7684 and oAA7685, and all pieces were cloned by overlap PCR and topo cloned, generating plasmid pAA3060. pAA3060 was then digested with BamHI and PstI and the resulting fragment was integrated into the sAA002 genome with URA selection. Correct leu2::URA3/LEU2 transformants were identified and plated onto 5'FOA for the loop-out of URA3, leaving a URA3 terminator scar. One correct transformant was identified and saved as strain sAA9658. In order to knock out the second copy of Leu2 from the genome, plasmid pAA2417 with a 204 bp and a 283 bp homology region to both the 5' and 3' region nested respectively of the Leu2 gene was constructed with a URA3 selection cassette. The 5' region was amplified with oAA7941 and oAA7942, the 3' region was amplified with oAA7945 and oAA7946, the URA3 cassette was amplified from pAA408 using oAA7943 and oAA7944, and all pieces were cloned by overlap PCR and topo cloned, generating plasmid pAA2417. pAA2417 was then digested with BamHI and PstI and the resulting fragment was integrated into the sAA9658 genome with URA selection. Correct leu2/leu2::URA3 transformants were identified and plated onto 5'FOA for the loop-out of URA3, leaving a URA3 terminator scar. One correct transformant was identified and saved as strain sAA9684.

Example 63: Construction of sAA9703, Leucine Auxotrophy in a Ras2/RAS2 Background In order to knock out the first copy of Leu2 from the genome, plasmid pAA3060 was digested with BamHI and PstI and the resulting fragment was integrated into the sAA9539 genome with URA selection. Correct leu2::URA3/LEU2 transformants were identified and plated onto 5'FOA for the loop-out of URA3, leaving a URA3 terminator scar. One correct transformant was identified and saved as strain sAA9682. In order to knock out the second copy of Leu2 from the genome, plasmid pAA2417 was digested with BamHI and PstI and the resulting fragment was integrated into the sAA9682 genome with URA selection. Correct leu2/leu2::URA3 transformants were identified and plated onto 5'FOA for the loop-out of URA3, leaving a URA3 terminator scar. One correct transformant was identified and saved as strain sAA9703.

Example 64: Construction of Strain sAA9748 for Production of Lycopene with Leucine Auxotrophy In order to integrate genes into the genome of *C. viswanathii*, genes were cloned into a plasmid that allows for single crossover recombination at the URA3 loci. In addition, since oleic acid was the primary carbon source, all genes were expressed under a HDE promoter with a POX4 terminator. Integration cassettes for XdCrtE, CsCrtB, and XdCrtI, were generated by PCR amplification of plasmids pAA3633, pAA2703, and pAA3634 with primers oAA2206 and oAA2209. All cassettes were purified and chemically transformed into strain sAA9684. The transformed cells were then plated onto SCD-ura plates with 1.60 g/L leucine supplementation. Colonies were streaked onto YPD for isolation and characterization. Colony PCR was performed to confirm the presence of all three genes, and one verified isolate was saved as strain sAA9748.

Example 65: Construction of Strain sAA9750 for Production of Lycopene with Leucine Auxotrophy In order to integrate genes into the genome of *C. viswanathii*, genes were cloned into a plasmid that allows for single crossover recombination at the URA3 loci. In addition, since oleic acid was the primary carbon source, all genes were expressed under a HDE promoter with a POX4 terminator. Integration cassettes for XdCrtE, CsCrtB, and XdCrtI, were generated by PCR amplification of plasmids pAA3633, pAA2703, and pAA3634 with primers oAA2206 and oAA2209. All cassettes were purified and chemically transformed into strain sAA9703. The transformed cells were then plated onto SCD-ura plates with leucine supplementation. Colonies were streaked onto YPD for isolation and characterization. Colony PCR was performed to confirm the presence of all three genes, and one verified isolate was saved as strain sAA9750.

Example 66: Construction of Single Crossover Cassettes with Leucine Selection

In order to integrate genes at the leu2 loci within the genome of *C. viswanathii*, single crossover plasmid pVZ4045 was generated by amplifying the native LEU2 promoter, open reading frame, and terminator in two pieces split in the open reading frame. The front portion was amplified using primers oVZ339 and oVZ340 using genomic DNA from sAA001, and back portion was amplified using primers oVZ341 and oVZ342 using genomic DNA from sAA001, and the base vector was pUC19 amplified using primers oVZ337 and oVZ338. Fragments were assembled such that the back fragment was 5' of the front fragment using overlap PCR and the resulting correct plasmid was designated pVZ4045. DNA constructs for integration with the single crossover cassettes were cloned in between the back and front portions. Fragments for integration were amplified using primers oVZ373 and oVZ374.

In order to integrate carotenoid genes at the leu2 loci within the genome of *C. viswanathii*, XdCrtE, CsCrtB, and XdCrtI were cloned using overlapping PCR along with the HDE promoter and POX4 terminator from plasmid pAA3633, pAA2703, and pAA3634 respectively using primers oVZ371 and oVZ372 into pVZ4045 amplified with primers oVZ369 and oVZ370, generating plasmids pVZ4056, pVZ4057, and pVZ4058 respectively.

In order to integrate mevalonate genes at the leu2 loci with the genome of *C. viswanathii*, each gene was cloned under the POX18 promoter and terminator. First, plasmid pVZ4083 was generated by cloning the POX18 promoter and terminator from genomic DNA isolated from sAA001 using primers oVZ376 and oVZ377, and cloned using overlap PCR into plasmid pVZ4045 amplified with primers oVZ378 and oVZ379. Each gene from the mevalonate pathway was then cloned into pVZ4083. Erg12 was amplified from genomic DNA isolated from sAA001 using primers oVZ394 and oVZ395, and pVZ4083 was amplified using primers oVZ392 and oVZ393, and overlap PCR was used to generate plasmid pVZ4101. Erg13 was amplified from genomic DNA isolated from sAA001 using primers oVZ386 and oVZ387, and pVZ4083 was amplified using primers oVZ384 and oVZ385, and overlap PCR was used to generate plasmid pVZ4099. Erg20 was amplified from genomic DNA isolated from sAA001 using primers oVZ410 and oVZ411, and pVZ4083 was amplified using primers oVZ408 and oVZ409, and overlap PCR was used to generate plasmid pVZ4105. HMG1 was amplified from genomic DNA isolated from sAA001 using primers oVZ390 and oVZ391, and pVZ4083 was amplified using primers oVZ388 and oVZ389, and overlap PCR was used to generate plasmid pVZ4100. IDI1 was amplified from genomic DNA isolated from sAA001 using primers oVZ406 and oVZ407, and pVZ4083 was amplified using primers oVZ404 and oVZ405, and overlap PCR was used to generate plasmid pVZ4104. Erg8 was amplified from genomic DNA isolated from sAA001 using primers oVZ481 and oVZ399, and pVZ4083 was amplified using primers oVZ396 and oVZ480, and overlap PCR was used to generate plasmid pVZ4122. MVD1 was amplified from genomic DNA isolated from sAA001 using primers oVZ402 and oVZ479, and pVZ4083 was amplified using primers oVZ478 and oVZ401, and overlap PCR was used to generate plasmid pVZ4123.

Example 67: Construction of Strains sAA9811, sAA9812, and sAA9814 for Production of Lycopene In order to integrate genes into the genome of *C. viswanathii*, genes were cloned into a plasmid that allows for single crossover recombination at the leu2 loci. Three libraries of genes were integrated into sAA9748 using leucine selection. Integration cassettes for XdCrtE, CsCrtB, and XdCrtI were generated by PCR amplification of plasmids pVZ4056, pVZ4057, and pVZ4058 respectively using primers oVZ373 and oVZ374. All cassettes were purified and chemically transformed into strain sAA9748. The transformed cells were then plated onto SCD-leu plates. Colonies were streaked onto YPD for isolation and characterization. Colony PCR was performed to confirm the presence of all three genes, and one verified isolate was saved as strain sAA9811.

Integration cassettes for Erg10, Erg13, HMG1, Erg12, Erg8, MVD1, IDI1, and Erg20 were generated by PCR amplification of plasmids pVZ4098, pVZ4099, pVZ4100, pVZ4101, pVZ4122, pVZ4123, pVZ4104, and pVZ4105 using primers oVZ373 and oVZ374. All cassettes were purified and chemically transformed into strain sAA9748. The transformed cells were then plated onto SCD-leu plates. Colonies were streaked onto YPD for isolation and characterization. Colony PCR was performed to confirm the presence of all eight genes, and one verified isolate was saved as strain sAA9812.

Integration cassettes for XdCrtE, CsCrtB, XdCrtI, Erg10, Erg13, HMG1, Erg12, Erg8, MVD1, IDI1, and Erg20 were generated by PCR amplification of plasmids pVZ4056, pVZ4057, pVZ4058, pVZ4098, pVZ4099, pVZ4100, pVZ4101, pVZ4122, pVZ4123, pVZ4104, and pVZ4105 respectively using primers oVZ373 and oVZ374. All cassettes were purified and chemically transformed into strain sAA9748. The transformed cells were then plated onto SCD-leu plates. Colonies were streaked onto YPD for isolation and characterization. Colony PCR was performed to confirm the presence of all 11 genes. One verified isolate contained all genes except overexpression of Erg8, and was saved as strain sAA9814.

Example 68: Construction of Strains sAA9817, sAA9819, and sAA9821 for Production of Lycopene In order to integrate genes into the genome of C. viswanathii, genes were cloned into a plasmid that allows for single crossover recombination at the leu2 loci. Three libraries of genes were integrated into sAA9750 using leucine selection. Integration cassettes for XdCrtE, CsCrtB, and XdCrtI were generated by PCR amplification of plasmids pVZ4056, pVZ4057, and pVZ4058 respectively using primers oVZ373 and oVZ374. All cassettes were purified and chemically transformed into strain sAA9750. The transformed cells were then plated onto SCD-leu plates. Colonies were streaked onto YPD for isolation and characterization. Colony PCR was performed to confirm the presence of all three genes, and one verified isolate was saved as strain sAA9819.

Integration cassettes for Erg10, Erg13, HMG1, Erg12, Erg8, MVD1, IDI1, and Erg20 were generated by PCR amplification of plasmids pVZ4098, pVZ4099, pVZ4100, pVZ4101, pVZ4122, pVZ4123, pVZ4104, and pVZ4105 using primers oVZ373 and oVZ374. All cassettes were purified and chemically transformed into strain sAA9750. The transformed cells were then plated onto SCD-leu plates. Colonies were streaked onto YPD for isolation and characterization. Colony PCR was performed to confirm the presence of all eight genes. One verified isolate contained all genes except overexpression of Erg8, and was saved as strain sAA9817.

Integration cassettes for XdCrtE, CsCrtB, XdCrtI, Erg10, Erg13, HMG1, Erg12, Erg8, MVD1, IDI1, and Erg20 were generated by PCR amplification of plasmids pVZ4056, pVZ4057, pVZ4058, pVZ4098, pVZ4099, pVZ4100, pVZ4101, pVZ4122, pVZ4123, pVZ4104, and pVZ4105 respectively using primers oVZ373 and oVZ374. All cassettes were purified and chemically transformed into strain sAA9750. The transformed cells were then plated onto SCD-leu plates. Colonies were streaked onto YPD for isolation and characterization. Colony PCR was performed to confirm the presence of all eleven genes. One verified isolate contained all genes except overexpression of Erg8 and IDI1, and was saved as strain sAA9821.

Example 69: Shake Flask Characterization of sAA9811, sAA9812, sAA9814, sAA9817, sAA9819, and sAA9821 on Oleic Acid Starter cultures (5 mL) of sAA9811, sAA9812, sAA9814, sAA9817, sAA9819, and sAA9821 in YPD were incubated overnight at 30° C., with shaking at approximately 250 rpm. The overnight cultures were used to inoculate 25 mL fresh SP92-glycerol media (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glycerol) to an initial OD600 nm of 0.4 and incubated approximately 24 hours at 30° C., and 300 rpm shaking. Cells were pelleted by centrifugation for 10 minutes at 3,000×g, at 4° C., and then resuspended in 12.5 mL HiP-TAB media (yeast nitrogen base without amino acids and without ammonium sulfate, 1.7 g/L; yeast extract, 3.0 g/L; potassium phosphate monobasic, 10.0 g/L; potassium phosphate dibasic, 10.0 g/L) and added to 250 mL baffled shake flasks. 500 μL of oleic acid was added to the shake flasks, which were shaken at approximately 300 rpm, at 30° C. Cultures were incubated for 48 hours and samples were taken at 48 hours for analysis of carotenoid production by HPLC, and results are presented in Table 22 above.

Example 70: Genes

TABLE 23

| Gene | Organism | Protein sequence | SEQ ID NO |
|---|---|---|---|
| CsCrtE | Chronobacter sakazakii | MNANAVKSSGQEIELQALRDALQTRLDELLPPGQERDLVCAAMREGALTPGKRVRPLLLILAARD LGCDASQPALMDLACAVEMVHAASLMLDDIPCMDNALLRRGKPTIHRQYGESVAILAAVALLSRA FGVVAQANPLSDSCKTQAVSELSSAVGLQGLVQGQFRDLSEGNQARSAEAILATNDLKTSVLFD ATLQIAAIAAGASASVRHKLREFSRHLGQAFQLLDDLADGLNHTGKDINKDAGKSTLVAMLGPEA VHQRLRDHLLRADEHLTGACSRGASTRRFMYAWFDKQLAMFG | 326 |
| CsCrtI | Chronobacter sakazakii | MTKTVVIGSGFGGLALAIRLQAAGVPTLLLEQRDKPGGRAYVYEDKGFTFDAGPTVITDPSAIEEL FTLAGKNIADYVDLLPVTPFYRLCVVENGQVFNYDNDQASLEAQIARFNPRDVEGYRQFLAYSQA VFKEGYLKLGAVPFLSFRDMLRAGPQLARLQAWRSVYGMVSKFIENDHLRQAFSFHSLLVGGNP FATSSIYTLIHALERQWGVVVFARGGTGALVQGLVKLFTDLGGEIELNAKVTRLDTQGDKISGVTLA DGRRIPARAVASNADVVHTYNNLLGHHPRGVSQAASLRRKRMSNSLFVLYFGLNHHHSQLAHHT VCFGPRYKGLIEDIFKRDSLADDFSLYLHAPCVTDPSLAPPGCGSYYVLAPVPHLGTANLNWDVE GPRLRDRIFEYLEQHYMPGLRDQLVTHRMFTPFDFRDQLGAYHGSAFSVEPILTQSAVVFRPHNR DSRIDNLYLVGAGTHPGAGIPGVIGSAKATAGLMLEGHA | 327 |
| CsCrtB | Chronobacter sakazakii | MSDKPLLTHATETIEAGSKSFATASKLFDAKTRRSALMLYAWCRHCDDVTDGQALGFRAADAPT DTPQARIALLRALTLEAYAGKPMREPNFAAFQEVALAHQIPPALALDHLEGFAMDVREERYHTFD DTLRYCYHVAGVVGLMMARVMGVRDEAVLDRACDLGLAFQLTNIARDIVEDAAIGRCYLPEAWL QEEGLCADTLTDRAHRPALARLAARLVDEAEPYYASARAGLAGLPLRSAWAIATAHGVYREIGVK VKRAGVNAWETRQGTSKAEKLALLAKGAVMAVSSRGASSSPRPSALWQRPRAQDDRYAHAAP PAA | 328 |

TABLE 23-continued

| Gene | Organism | Protein sequence | SEQ ID NO |
|---|---|---|---|
| XdCrtE | Xanthophyllomyces dendrorhous | MDYANILTAIPLEFTQDDIVLLEPYHYLGKNPGKEIRSQLIEAFNYWLDVKKEDLEVIQNVVGMLH TASLLMDDVEDSSVLRRGSPVAHLIYGIPQTINTANYVYFLAYQEIFKLRPTPIPMPVIPPSSASLQS SVSSASSSSASSENGGTSTPNSQIPFSKDTYLDKVITDEMLSLHRGQGLELFWRDSLTCPSEEE YVKMVLGKTGGLFRIAVRLMMAKSECDIDFVQLVNLISIYFQIRDDYMNLQSSEYAHNKNFAEDLT EGKFSFPTIHSIHANPSSRLVINTLQKKSTSPEILHHCVNYMRTETHSFEYTQEVLNTLSGALEREL GRLQGEFAEANSKIDLGDVESEGRTGKNVKLEAILKKLADIPL | 329 |
| XdCrtI | Xanthophyllomyces dendrorhous | MGKEQDQDKPTAIIVGCGIGGIATAARLAKEGFQVTVFEKNDYSGGRCSLIERDGYRFDQGPSLL LLPDLFKQTFEDLGEKMEDWVDLIKCEPNYVCHFHDEETFTFSTDMALLKREVERFEGKDGFDR FLSFIQEAHRHYELAVVHVLQKNFPGFAAFLRLQFIGQILALHPFESIWTRVCRYFKTDRLRRVFSF AVMYMGQSPYSAPGTYSLLQYTELTEGIWYPRGGFWQVPNTLLQIVKRNNPSAKFNFNAPVSQV LLSPAKDRATGVRLESGEEHHADVVIVNADLVYASEHLIPDDARNKIGQLGEVKRSVWWADLVGG KKLKGSCSSLSFYWSMDRIVDGLGGHNIFLAEDFKGSFDTIFEELGLPADPSFYVNVPSRIDPSAA PEGKDAIVILVPCGHIDASNPQDYNKLVARARKFVIQTLSAKLGLPDFEKMIVAEKVHDAPSWEKE FNLKDGSILGLAHNFMQVLGFRPSTRHPKYDKLFFVGASTHPGTGVPIVLAGAKLTANQVLESFD RSPAPDPNMSLSVPYGKPLKSNGTGIDSQVQLKFMDLERWVYLLVLLIGAVIARSVGVLAF | 330 |
| XdCrtYB | Xanthophyllomyces dendrorhous | MTALAYYQIHLIYTLPILGLLGLLTSPILTKFDIYKISILVFIAFSATTPWDSWIIRNGAWTYPSAESGQ GVFGTFLDVPYEEYAFFVIQTVITGLVYVLATRHLLPSLALPKTRSSALSLALKALIPLPIIYLFTAHP SPSPDPLVTDHYFYMRALSLLITPPTMLLAALSGEYAFDWKSGRAKSTIAAIMIPTVYLIWDYVAV GQDSWSINDEKIVGWRLGGVLPIEEAMFFLLTNLMIVLGLSACDHTQALYLLHGRTIYGNKKMPSS FPLITPPVLSLFFSSRPYSSQPKRDLELAVKLLEEKSRSFFVASAGFPSEVRERLVGLYAFCRVTD DLIDSPEVSSNPHATIDMVSDFLTLLFGPPLHPSQPDKILSSPLLPPSHPSRPTGMYPLPPPPSLSP AELVQFLTERVPVQYHFAFRLLAKLQGLIPRYPLDELLRGYTTDLIFPLSTEAVQARKTPIETTADLL DYGLCVAGSVAELLVYVSWASAPSQVPATIEEREAVLVASREMGTALQLVNIARDIKGDATEGRF YLPLSFFGLRDESKLAIPTDWTEPRPQDFDKLLSLSPSSTLPSSNASESFRFEWKTYSLPLVAYAE DLAKHSYKGIDRLPTEVQAGMRAACASYLLIGREIKVVWKGDVGERRTVAGWRRVRKVLSVVMS GWEGQ | 331 |
| PaCrtE | Pantoea ananatis | MTVCAKKHVHLTRDAAEQLLADIDRRLDQLLPVEGERDVVGAAMREGALAPGKRIRPMLLLLTAR DLGCAVSHDGLLDLACAVEMVHAASLILDDMPCMDDAKLRRGRPTIHSHYGEHVAILAAVALLSK AFGVIADADGLTPLAKNRAVSELSNAIGMQGLVQGQFKDLSEGDKPRSAEAILMTNHFKTSTLFC ASMQMASIVANASSEARDCLHRFSLDLGQAFQLLDDLTDGMTDTGKDSNQDAGKSTLVNLLGPR AVEERLRQHLQLASEHLSAACQHGHATQHFIQAWFDKKLAAVS | 332 |
| PaCrtI | Pantoea ananatis | MKPTTVIGAGFGGLALAIRLQAAGIPVLLLEQRDKPGGRAYVYEDQGFTFDAGPTVITDPSAIEELF ALAGKQLKEYVELLPVTPFYRLCWESGKVFNYDNDQTRLEAQIQQFNPRDVEGYRQFLDYSRAV FKEGYLKLGTVPFLSFRDMLRAAPQLAKLQAWRSVYSKVASYIEDEHLRQAFSFHSLLVGGNPFA TSSIYTLIHALEREWGVVVFPRGGTGALVQGMIKLFQDLGGEVVLNARVSHMETTGNKIEAVHLED GRRFLTQAVASNADVVHTYRDLLSQHPAAVKQSNKLQTKRMSNSLFVLYFGLNHHHDQLAHHTV CFGPRYRELIDEIFNHDGLAEDFSLYLHAPCVTDSSLAPEGCGSYYVLAPVPHLGTANLDWTVEG PKLRDRIFAYLEQHYMPGLRSQLVTHRMFTPFDFRDQLNAYHGSAFSVEPVLTQSAWFRPHNRD KTITNLYLVGAGTHPGAGIPGVIGSAKATAGLMLEDLI | 333 |
| PaCrtB | Pantoea ananatis | MNNPSLLNHAVETMAVGSKSFATASKLFDAKTRRSVLMLYAWCRHCDDVIDDQTLGFQARQPAL QTPEQRLMQLEMKTRQAYAGSQMHEPAFAAFQEVAMAHDIAPAYAFDHLEGFAMDVREAQYSQ LDDTLRYCYHVAGVVGLMMAQIMGVRDNATLDRACDLGLAPQLTNIARDIVDDAHAGRCYLPAS WLEHEGLNKENYAAPENRQALSRIARRLVQEAEPYYLSATAGLAGLPLRSAWAIATAKQVYRKIG VKVEQAGQQAWDQRQSTTTPEKLTLLLAASGQALTSRMRAHPPRPAHLWQRPL | 334 |
| XdCrtR | Xanthophyllomyces dendrorhous | MATLSDLVILLLGALLALGFYNKDRLLGSSSSSASTTSGSSAATANGSKPTYSNGNGNAFKGDPR DFVARMKDQKKRLAVFYGSQTGTAEEYATRIAKEAKSRFGVSSLVCDIEEYDFEKLDQVPEDCAI VFCMATYGEGEPTDNAVQFIEMISQDDPEFSEGSTLDGLKYVVFGLGNKTYEQYNVVGRQLDAR LTALGATRVGERGEGDDDKSMEEDYLAWKDDMFAALATTLSFEEGASGETPDFVVTEVPNHPIE KVFQGELSSRALLGSKGVHDAKNPYASPVLACRELFTGGDRNCIHLEFDITGSGITYQTGDHVAV WPSNPDVEVERLLAVLGLTSPEKRRMIIQVVSLDPTLAKVPFPTPTTYDAVFRHYLDISAVASRQT LAVLAKYAPSEQAAEFLTRLGTDKQAYHTEVVGGHLRLAEVLQLAAGNDITVMPTAENTTVWNIP FDHVVSDVSRLQPRFYSISSSPKLHPNSIHVTAVILKYESQATDRHPARWVFGLGTNYLLNVKQA ANNETTPMISDGQDDVPEHVSAPKYTLEGPRGSYKHDDQLFKVPIHVRRSTFRLPTSPKIPVIMIG PGTGVAPFRGFIQERIALARRSIAKNGPDALADWAPIYLFYGSRDEQDFLYAEEWPAYEAELQGK FKIHVAFSRSGPRKPDGSKIYVQDLLWDQKEVIKSAIVEKRASVYICGDGRNMSKDVEQKLAAML AESKNGSAAVEGAAEVKSLKERSRLLMDVWS | 335 |
| XdCrtS | Xanthophyllomyces dendrorhous | MFILVLLTGALGLAAFSWASIAFFSLYLAPRRSSLYNLQGPNHTNYFTGNFLDILSARTGEEHAKY REKYGSTLRFAGIAGAPVLNSTDPKVFNHVMKEAYDYPKPGMAARVLRIATGDGVVTAEGEAHK RHRRIMIPSLSAQAVKSMVPIFLEKGMELVDKMMEDAAEKDMAVGESAGEKKATRLETEGVDVK DWVGRATLDVMALAGFDYKSDSLQNKTNELYVAFVGLTDGFAPTLDSFKAIMWDFVPYFRTMKR RHEIPLTQGLAVSRRVGIELMEQKKQAVLGSASDQAVDKKDVQGRDILSLLVRANIAANLPESQKL SDEEVLAQISNLLFAGYETSSTVLTWMFHRLSEDKAVQDKLREEICQIDTDMPTLDELNALPYLEA FVKESLRLDPPSPYANRECLKDEDFIPLAEPVIGRDGSVINEVRITKGTMVMLPLFNINRSKFIYGE DAEEFRPERVVLEDVTDSLNSIEAPYGHQASFISGPRACFGWRFAVAEMKAFLFVTLRRVQFEPII SHPEYEHITLIISRPRIVGREKEGYQMRLQVKPVE | 336 |
| ERG10 | Candida viswanathii | MTLPPVYIVSTARTPIGSFQGSLSSLTYSDLGAHAVKAALAKVPQIKPQDVDEIVFGGVLQANVGQ APARQVALKAGLPDSIIASTINKVCASGMKAVIIGAQNIICGTSDIVVVGGAESMSNTPYYLPSARS GARYGDAVMVDGVQKDGLLDVYEEKLMGVAAEKCAKDHGFSREDQDNFAINSYKKAGKALSEG KFKSEIAPVTIKGFRGKPDTVIENDEEIGKFNEDRLKSARTVFQKENGTVTAPNASKLNDGGAALV | 337 |

TABLE 23-continued

| Gene | Organism | Protein sequence | SEQ ID NO |
|---|---|---|---|
| | | LVSEAKLKQLGLKPLAKISGWGEAARTPFDFTIAPALAVPKAVKHAGLTVDRVDFFELNEAFSVVG LANAELVKIPLEKLNVYGGAVAMGHPLGCSGARIIVTLLSVLTQEGGRFGAAGVCNGGGGASAIVI EKIDSDAKL | |
| ERG13 | Candida viswanathii | MTNAPQNIGIKGIEVYIPGQAVNQSDLEKFDGIPAGKYTIGLGQTNMAFVNDREDIYSIALTVVSRLI KHYNVDTNNVGRLEVGTETLLDKSKSVKSVLMQLFPDNNDIEGIDTVNACYGGTSAVINAINWIES SSWDGRDAIVVAGDIAIYDKGAARPTGGAGSIAMLIGPDAPIVFDSVRGSFMEHAYDFYKPDFTSE YPVVDGHFSLSCYVKAVDNCYKNYSKKVTGNVDKTVGVYDHFDYNAFHVPTCKLVTKSYARLLY NDYKSDPSKFADLIDESTRQHIDSLSYEASLTDKVLEKTFVTLAKEETKKRVQPALQVPTNTGNMY TASSWVSLASLLYVGAENLKEKRIGLFSYGGLASTLLSVTVVGDVSPITKVLDFDYKLGEGRKI QSPEEYLAAIELREKAHLQKSFKPQGSLDNLSQGTYYLTEVDDKFRRSYAIKE | 338 |
| HMG1 | Candida viswanathii | MLSFITEASGRIAQTAAHRPIHFMVIPALLASIAYLSIIDDYVPEHIRAQYMSGVSYFHPQGSASDLD KWIEIHDTTQYANANQISVIPLRFRRFHDSIPQIANAIKISNNEQILIVPSDKAESTVEGLSEITENGIT WRARNNDKLSKYYDYARYGLLRIQDAIHNADNFDILLVFVAYLGMWYSLIKVFIDMRRIGSKFWLA FGTLTSSTFSFLFALVISNKFLDAKVSLRSLSECIPPLVAIIGFKHKVAITTSVAQSSTSSPEDVPHVV GKAVSDQCLFILRDHLVVIIGPLACAAYGNELKGLRNFCILGALILSFDIVSVYTFFSAILALKVEINRA RRTQDLQHVLEEDGISSLVAARVAERNATIEHPNETNFFSSNNSSIVYFKVIMSLGFFAFHAFWLG SSWLYNTSDGGSHGSFSFLSNIPLLTQDISNSIPIGRRGTVVTILPTTFYMPSGIIIQFEDMVYLALS KISSAIRDSLISKCIVFALTISIVTNIYFLNAARFQVSATRKLIDQEMSRPKQAAAAAAAAPSAAKSVA PEEDEDETSSEELEIKAPVKPLSLEECTRILKEGKVKTLSNAEVSSLVVGGKLPLYALEKQLGDNK RAVAVRRKAIAKLANAPVLETNRLPYSHYDVDRVFGACCENVIGYMPIPVGVAGPLVIDGKPYHIP MATTEGCLVASTMRGCKAINAGGGVETVLTKDGMTRGPCVRFPTLKRAGAAKLWIDSEEGQITIK KAFNSTSRFARLQHIQTALAGTSLFIRFRTTTGDAMGMNMISKGVEYSLKHMVEECGWDDMEVIS VSGNYCTDKKPAAINWIEGRGKSIVAAATIPADVVTKVLKSDVDALVELNVSKNLVGSAMAGSVG GFNAHAANLVTAVYLACGQDPAQNVESSNCITLMEKDKQTGDLVISVSMPSIEVGTIGGGTILEPQ AAMLDLLGVRGPHPTNPGDNARQLAKIVASAVLAAELSLCSALAAGHLVQSHMQHNRKGATPAA APAISNGSAKGTKTNGSINGKDLKRLKDGSVTCIKS | 339 |
| ERG12 | Candida viswanathii | MSVSPFVVSAPGKVIIFGEHSAVYGKPAIAAALSLRCYLLVSPSVDDANTIRLQFPDIQLDHSWDIN DIPWDEIKPFVKYDANNKPLTSSELVPEIVDKLSPLLTDFDNKMHYYACFCFLYLYVNLCTAETPG TTFIVRSTLPIGAGLGSSASTSVCLSSALALLGGWISEPSISATDKILNEDIPDLEFVDKWSLIGEKC FHGNPSGIDNAVATFGGAVMFQRTSAPEQPSIRTNMRNFPAIKLLLTNTKVPKSTADLVAGVGKL NAEFNPITTSILTAMEHLSQEAYKVMITPGFGKDETNTLRKLVNINHGLLVALGVSHPSLETVKIIGD RHKIGATKLTGAGGGGCAITLVNDNVEESAIQEAIKEFAGEGYESFETSLGGKGVGVLFSGDVSV DGKFSQSVFCNYPDRASIEDALGMINVKEWKFW | 340 |
| ERG8 | Candida viswanathii | MSKAFSAPGKALLAGGYLVLEPTYDAYVTALSSRMHAIITPQKPASISKIKISSPQFANGEWEYHV TSNEKPKDIKSRSNPFLEATIFIVLSYIQPTEPFDLDLVIYSDPGYHSQEHTTQKVSSNGKKKFLYH SRAINDVEKTGLGSSAGLVSVVTTSLLSYFIPGIEESNKDMLHNVAQIAHCFAQKKIGSGFDVATAI YGSIVYRRFQPSLINDVFEILEETPGRFPGALKSLVESNVVEFKHERCVLPPKIKLLMGDIKGGSET PKLVSKILQWKKDKPEESGLVYDQLNSANVAFMKKISTLNESSQVQEIDELSDYISAVRKGLQELT EKSKVPVEPPVQTELLDRIAKLPGCLGGVVPGAGGYDAIAVLVLEKEVENFRNKTLENPEYYHNV YWVDLEEETEGVVVENWEDYIGL | 341 |
| MVD1 | Candida viswanathii | MYSASVTAPVNIATLKYWGKRDKTLNLPTNSSISVTLSQDDLRTLTTAAASTTFDKDQLWLNGKLE SLDTPRTQACLVDLRKLRADVEQANADLPKLSTMKLHIVSENNFPTAAGLASSAAGFAALITAIAKL YELPQDMSELSKIARKGSGSACRSLFGGFVAWEMGDAADGQDSKAVEVAPLDHWPSMRAVILV VSDDKKDTPSTTGMQATVQTSDLFAHRVTKVVPQCFEEMKKAIVAKDFPKFTELTMKDSNSFHA VCLDSYPPIFYLNDTSKKIIKLVEAINKHATIAAYTFDAGPNAVIYYDAANEDEVLSQLYKSFGHVQG WKKAYTAETAVAGVSRIIQTSIGQGPVTNESLINESGLPN | 342 |
| IDI1 | Candida viswanathii | MSSEYAKLVASFSPNDILAKWPEVTPLKKISGIPRSAESDSSNGSHNNTELFNGHDEEQIRLMEEL CIVLDYDDKPVGAGTKKLCHIMDNINEGLLHRAFSVFLFNEDGKLLLQQRADEKITFPAMWTNTCC SHPLCVPSELGVDADAKDVNNLDNAVHGKAVAAQRKLDHELGIPFSDTPLDQFTYLTRIHYKSAS GAEDSKWGEHEIDYILILKTKNDITINANYNEVKDYKYVDAKELQEMFEDKDLVFTPWFKLICQSFL FKWWVNNLSDLEKYQDTEIHRLL | 343 |
| ERG20 | Candida viswanathii | MSDKAAARERFLSVFECAVEELKEVLVSHKMPQEAIDWFVKNLNYNTPGGKLNRGLSVVDTYAIL NNTTADKLNDEQYKKVALLGWSIELLQAYFLVADDMMDQSKTRRGQKCWYLVEGVGNIAINDSF MLEGAIYVLLKKHFRQDPYYVDLLDLFHEVTFQTELGQLLDLVTADEEVVDLDKFSLDKHSFIVIFK TAYYSFYLPVALAMYMSGISSEEDLKQVRDILIPLGEYFQIQDDFLDCFGTPEQIGKIGTDIKDNKC SWVVNQALLHATPEQRKLLDDNYGKKDDESEQRCKDLFKSMGIEKIYHDYEESIVAKLREQIDKV DESRGLKKDVLTAFLGKVYKRSK | 344 |
| BTS1 | Candida viswanathii | MSFNIDSLIQPGAAYDPSMTDAIMKPYRYISEVPSNNHNVRTRFLLAFNELFYGMKNEDLLHRISHI ISVFHNSSLLIDDIEDDSQLRRGMPVAHVKYGVPLTINCGNMMYFVAVQKAIDLAGEAGSAELKFE TSQILVDEMMNVHHGQGLDIYWRDYLKDLEHLPEIEDYLGMVKDKTGSLFRLAIKLLSLHSDVGE DNGLVAIANLLGIIYQIRDDYLNLVDIKYSAMKGVTCEDLIEGKLSLPILHCLRTTTNSPVHEILYNYN TSAERAKQNALIEECLTYMKNKSRSLQYTLDLIKTLERKIKAMMTKYPNSENSGLIKIIDRLCDL | 345 |
| CRC1 | Candida viswanathii | MDDVDSALADNVKSFAAGGFGGIICAVLTGHPFDLVKVRLQTGLYKSSVQCVKETIAKDGLFGLYR GVLPPLLGVTPMFAVSFWGYDVGKKLVSSFTGKSVDKFEIKDISTAGFISAIPTTLVAAPFERVVK MMQIQEGAKSSMGAVVAEMYRTGGIRSIFKGTVATLARDGPGSALYFATYEWVKKELTAPGED LSLFAITTAGGFAGIAMVVLGVFPIDTIKSTQQSSNVKVSIVQATKNIYAKGGIKAFFPGVGPALARA FPANAATFLGVELARKFLDKVI | 346 |

TABLE 23-continued

| Gene | Organism | Protein sequence | SEQ ID NO |
|---|---|---|---|
| FAA1 | Candida viswanathii | MGAPLTVAVGEAKPGETAPRRKAAQKMASVERPTDSKATTLPDFIEECFARNGTRDAMAWRDL VEIHVETKQVTKIIDGEQKKVDKDWIYYEMGPYNYISYPKLLTLVKNYSKGLLELGLAPDQESKLMI FASTSHKWMQTFLASSFQGIPVVTAYDTLGESGLTHSLVQTESDAVFTDNQLLSSLIRPLEKATSV KYVIHGEKIDPNDKRQGGKIYQDAEKAKEKILQIRPDIKFISFDEVVALGEQSSKELHFPKPEDPICI MYTSGSTGAPKGVVITNANIVAAVGGISTNATRDLVRTVDRVIAFLPLAHIFELAFELVTFWWGAPL GYANVKTLTEASCRNCQPDLIEFKPTIMVGVAAVWESVRKGVLSKLKQASPIQQKIFWAAFNAKS TLNRYGLPGGGLFDAVFKKVKAATGGQLRYVLNGGSPISVDAQVFISTLLAPMLLGYGLTETCAN TTIVEHTRFQIGTLGTLVGSVTAKLVDVADAGYYAKNNQGEIWLKGGPVVKEYYKNEEETKAAFT EDGWFKTGDIGEWTADGGLNIIDRKKNLVKTLNGEYIALEKLESIYRSNHLILNLCVYADQTKVKPI AIVLPIEANLKSMLKDEKIIPDADSQELSSLVHNKKVAQAVLRHLLQTGKQQGLKGIELLQNVVLLD DEWTPQNGFVTSAQKLQRKKILESCKKEVEEAYKSS | 347 |
| FAT1 | Candida viswanathii | MSGLEIAAAAILGSQLLEAKYLIADDVSLAKTVAVLNALPYLWKASRGKASYWYFFEQSVFKNPNN KALAFPRPRKNAPTPKTDAEGFQIYDDQFDLEEYTYKELYDMVLKYSYILKNEYGVTANDTIGVSC MNKPLFIVLWLALWNIGALPAFLNFNTKDKPLIHCLKIVNASQVFVDPDCDSPIRDTEAQIREELPH VQINYIDEFALFDRLRLKSTPKHRAEDKTRRPTDTDSSACALIYTSGTTGLPKAGIMSWRKAFMAS VFFGHIMKIDSKSNVLTAMPLYHSTAAMLGLCPTLIVGGCVSVSQKFSATSPVVTQARLCGATHVQ YVGEVCRYLLNSKPHPDQDRHNVRIAYGNGLRPDIWSEFKRRFHIEGIGEFYAATESPIATTNLQY GEYGVGACRKYGSLISLLLSTQQKLAKMDPEDESEIYKDPKTGFCTEAAYNEPGELLMRILNPND VQKSFQGYYGNKSATNSKILTNVFKKGDAWYRSGDLLKMDEDKLLYFVDRLGDTFRVVKSENVS ATEVENELMGSKALKQSVVVGVKVPNHEGRACFAVCEAKDELSHEEILKLIHSHVTKSLPVYAQP AFIKIGTIEASHNHKVPKNQFKNQKLPKGEDGKDLIYWLNGDKYQELTEDDWSLICTGKAKL | 348 |
| LEU2 | Candida viswanathii | MSVKTKTITILPGDHVGTEIVAEAIKSLHAIESSTPYQKVHFEFKHHLIGGAAIDATGVPLPDDALAA AKSSDAVLLGAVGGPKWGTAVRPEQGLLKIRKELNLYANIRPCNFASDSLLELSPLRPEVVKGT NLIIVRELVGGIYFGERQEQEESEDGKSAWDTEKYTVDEVARITRMAAFMALQHTPPLPIWSLDKA NVLASSRLVVRKTVDKIISEEFPTLAVQHQLIDSAAMILIQNPTKLNGIIITSNMFGDIISDEASVIP GSLGLLPSASLASLPDTNTAFGLYEPCHGSAPDLPENKVNPIATILSVASMLRLSLDCVKEAEALE QAVKEVLDKGIRTADLRGSSTTTEVGDAVAETVSRILKEAKA | 349 |
| AaCrtZ | Agrobacterium aurantiacum | MTNFLIVVATVLVMELTAYSVHRWIMHGPLGWGWHKSHHEEHDHALEKNDLYGLVFAVIATVLFT VGWIWAPVLVVWIALGMTVYGLIYFVLHDGLVHQRWPFRYIPRKGYARRLYQAHRLHHAVEGRD HCVSFGFIYAPPVDKLKQDLKMSGVLRAEAQERT | 350 |
| AaCrtW | Agrobacterium aurantiacum | MSAHALPKADLTATSLIVSGGIIAAWLALHVHALWFLDAAAHPILAIANFLGLTWLSVGLFIIAHDAM HGSVVPGRPRANAAMGQLVLWLYAGFSWRKMIVKHMAHHRHAGTDDDPDFDHGGPVRWYAR FIGTYFGVVREGLLLPVIVTVYALILGDRWMYVVFWPLPSILASIQLFVFGTWLPHRPGHDAFPDRH NARSSRISDPVSLLTCFHFGGYHHEHHLHPTVPWWRLPSTRTKGDTA | 351 |
| CnTPS1 | Callitropsis nootkatensis | MAEMFNGNSSNDGSSCMPVKDALRRTGNHHPNLWTDDFIQSLNSPYSDSSYHKREILIDEIRD MFSNGEGDEFGVLENIWFVDVVQRLGIDRHFQEEIKTALDYIYKFWNHDSIFGDLNMVALGRILR LNRYVASSDVFKKFKGEEGQFSGFESSDQDAKLEMMLNLYKASELDFPDEDILKEARAFASMYL KHVIKEYGDIQESKNPLLMEIEYTFKYPWRCRLPEAWNFIHIMRQQDCNISLANNLYKIPKIYMK KILELAILDFNILQSQHQHEMKLISTWWKNSSAIQLDFFRHRHIESYFWWASPLFEPEFSTCRINCT KLSTKMFLLDDIYDTYGTVEELKPFTTTLTRWDVSTVDNHPDYMKIAFNFSYEIYKEIASEAERKHG PFVYKYLQSCWKSYIEAYMQEAEWIASNHIPGFDEYLMNGVKSSGMRILMIHALILMDTPLSEDIL EQLDIPSSKSQALLSLITRLVDDVKDFEDEQAHGEMASSIECYMKDNHGSTREDALNYLKIRIESC VQELNKELLEPSNMHGSFRNLYLNVGMRVIFFMLNDGDLFTHSNRKEIQDAITKFFVEPIIP | 352 |
| tHMG1 | Candida viswanathii | MDQEMSRPKQAAAAAVAPSAAKSVAPEEDEDETSSEELEIKAPVKPLPLEECTRILKEGKVKTLS NAEVSSLVVGGKLPLYALEKQLGDHKRAVAVRRKAIAKLANAPVLETNRLPYSHYDYDRVFGACC ENVIGYMPIPVGVAGPLVIDGKPYHIPMATTEGCLVASTMRGCKAINAGGGVETVLTKDGMTRGP CVRFPTLKRAGAAKLWIDSEEGQITIKKAFNSTSRFARLQHIQTALAGTSLFIRFRTTTGDAMGMN MISKGVEYSLKYMVEECGWDDMEVISVSGNYCTDKKPAAINWIEGRGKSIVAAATIPADVVTKVLK SDVDALVELNVSKNLVGSAMAGSVGGFNAHAANLVTAVYLACGQDPAQNVESSNCITLMEKDK QTGDLVISVSMPSIEVGTIGGGTILEPQAAMLDLLGVRGPHPTNPGDNARQLAKIVASAVLAAELS LCSALAAGHLVQSHMQHNRKGATAAAAAAAAPAIANGRANGTKTNGSINGKDLKRLKDGSVTCIK S | 353 |
| POX4 | Candida viswanathii | MTFTKKNVSVSQGPDPRSSIQKERDSSKWNPQQMNYFLEGSVERSELMKALAQQMERDPILFT DGSYYDLTKDQQRELTAVKINRIARYREQESIDTFNKRLSLIGIFDPQVGTRIGVNLGLFLSCIRGN GTTSQLNYWANEKETADVKGIYGCFGMTELAHGSNVAGLETTATFDKESDEFVINTPHIGATKW WIGGAAHSATHCSVYARLIVDGQDYGVKTFVVPLRDSNHDLMPGVTVGDIGAKMGRDGIDNGWI QFSNVRIPRFFMLQKFCKVSAEGEVTLPPLEQLSYSALLGGRVMMVLDSYRMLARMSTIALRYAI GRRQFKGDNVDPKDPNALETQLIDYPLHQKRLFPYLAAAYVISAGALKVEDTIHNTLAELDAAVEK NDTKAIFKSIDDMKSLFVDSGSLKSTATWLGAEAIDQCRQACGGHGYSSYNGFGKAYNDWVVQ CTWEGDNNVLAMSVGKPIVKQVISIEDAGKTVRGSTAFLNQLKDYTGSNSSKVVLNTVADLDDIK TVIKAIEVAIIRLSQEEASIVKKESFDYVGAELVQLSKLKAHHYLLTEYIRRIDTFDQKDLVPYLITLGK LYAATIVLDRFAGVFLTFNVASTEAITALASVQIPKLCAEVRPNVVAYTDSFQQSDMIVNSAIGRYD GDIYENYFDLVKLQNPPSKTKAPYSDALEAMLNRPTLDERERFEKSDETAAILSK | 354 |
| POX5 | Candida viswanathii | MPTELQKERELTKFNPKELNYFLEGSQERSEIISNMVEQMQKDPILKVDASYYNLTKDQQREVTA KKIARLSRYFEHEYPDQQAQRLSILGVFDPQVFTRIGVNLGLFVSCVRGNGTNSQFFYWTINKGID KLRGIYGCFGMTELANGSNVQGIETTATFDEDTDEFVINTPHIGATKWWIGGAAHSATHCSVYAR LKVKGKDYGVKTFVVPLRDSNHDLEPGVTVGDIGAKMGRDGIDNGWIQFSNVRIPRFFMLQKYC KVSRLGEVTMPPSEQLSYSALIGGRVTMMMDSYRMTSRFITIALRYAIHRRQFKKKDTDTIETKLID YPLHQKRLFPPFLAAAYLFSQGALYLEQTMNATNDKLDEAVSAGEKEAIDAAIVESKKLFVASGCLK |  355 |

TABLE 23-continued

| Gene | Organism | Protein sequence | SEQ ID NO |
|---|---|---|---|
| | | STCTWLTAEAIDEARQACGGHGYSSYNGFGKAYSDWVVQCTVVEGDNNILAMNVAKPMVRDLLK EPEQKGLVLSSVADLDDPAKLVKAFDHALSGLARDIGAVAEDKGFDITGPSLVLVSKLNAHRFLID GFFKRITPEWSEVLRPLGFLYADWILTNFGATFLQYGIITPDVSRKISSEHFPALCAKVRPNVVGLT DGFNLTDMMTNAAIGRYDGNVYEHYFETVKALNPPENTKAPYSKALEDMLNRPDLEVRERGEKS EEAAEILSS | |
| URA3 | Candida viswanathii | MVSTKTYTERASAHPSKVAQRLFRLMESKKTNLCASIDVTTTAEFLSLIDKLGPHICLVKTHIDIISD FSYEGTIEPLLVLAERHGFLIFEDRKFADIGNTVMLQYTSGVYRIAAWSDITNAHGVTGKGVVEGL KRGAEGVEKERGVLMLAELSSKGSLAHGEYTRETIEIAKSDREFVIGFIAQRDMGGREEGFDWIIM TPGVGLDDKGDALGQQYRTVDEVVLTGTDVIIVGRGLFGKGRDPEVEGKRYRDAGWKAYLKRT GQLE | 356 |

TABLE 24

| Gene | Organism | C.V. Codon Optimized Sequence | SEQ ID NO |
|---|---|---|---|
| CsCrtE | Chronobacter sakazakii | ATGAATGCTAATGCCGTTAAGTCCTCCGGTCAGGAAATCGAATTGCAAGCTTTGAGGGATGC CTTGCAAACACGCTTGGACGAATTGCTCCCACCCGGGCAGGAGAGAGACTTGGTTTGCGCA GCCATGCGCGAAGGGGCATTGACGCCAGGGAAGAGAGTTCGTCCATTACTTTTGATCTTGG CAGCGAGGGACTTGGGTTGCGACGCATCCCAGCCAGCCTTGATGGATTTAGCATGTGCAGT AGAGATGGTTCATGCGCCTCACTCATGTTGGATGATATTCCTGTATGGACAACGCCCTTTT GAGACGAGGTAAACCTACAATCCATCGACAGTACGGTGAGTCGGTGGCAATATTGGCGGCT GTTGCGTTGCTTAGCAGAGCATTCGGCGTTGTTGGCACAGGCGAACCCTCTATCTGACTCATG TAAGACCCAAGCAGTGTCGGAGCTTTCCTCGGCCGTTGGTTTGCAGGGGTTGGTGCAGGGT CAATTTCGTGATTTGTCCGAAGGGAACCAGGCAAGGAGTGCAGAAGCAATTTTGGCCACCAA CGATTTGAAAACCTCAGTGTTGTTCGACGCTACCTTACAGATTGCGGCCATTGCGGCAGGCA CAAGTGCGTCAGTTAGACACAAGTTGAGAGAGTTCTCTCGACACTTGGGGCAAGCTTCCAG TTGTTGGACGATTTAGCCGATGGATTAAACCACACGGGAAAGGATATCAACAAAGACGCTGG CAAGAGCACCCTTGTCGCAATGTTGGGTCCGGAAGCTGTGCACCAACGCTTGCGAGACCAT CTTCTTCGCGCAGATGAACACTTGACTGGTGCATGTTCAAGAGGTGCCTCCACCCGTCGCTT CATGTATGCATGGTTTGACAAACAGCTTGCAATGTTTGGGTAA | 357 |
| CsCrtI | Chronobacter sakazakii | ATGACCAAAACGGTTGTAATAGGATCAGGATTTGGGGGTCTCGCACTAGCCATTAGACTTCA AGCCGCTGGTGTACCAACCTTGTTGCTTGAGCAGCGAGACAAGCCGGGAGGCCGTGCATAT GTGTACGAGGACAAAGGATTTACCTTTGACGCCGGGCCCACTGTCATTACGGACCCATCCG CTATCGAAGAGTTTATTTACCCTTGCCGGTAAAAATATAGCTGATTACGTGGATTTGTTGCCAG TAACCCCCTTCTACCGTTTGTGTTGGGAAATGGTCAAGTGTTTAATTACGATAACGACCAAG CCAGTTTGGAAGCACAAATCGCACGTTTTAACCCAAGGGATGTGGAGGGTTACCGACAATTC CTCGCGTATTCACAAGCAGTATTTAAAGAGGGGTACTTGAAACTAGGCGCGGTTCCATTCTT GAGCTTCAGAGACATGTTGCGTGCGGGACCCCAATTGGCCAGACTCCAAGCCTGGAGGAGT GTCTATGGTATGGTTAGCAAGTTTATCGAGAACGATCATTTGCGACAAGCTTTCAGCTTCCAC AGTTTGTTGGTGGGTGGCAACCCATTCGCAACAAGCTCCATCTATACACTCATCCATGCCTT GGAAAGGCAGTGGGGCGTCTGGTTTGCCAGAGGAGGCACCGGAGCTTTGGTTCAGGGCTT AGTAAAGTTGTTTACTGATTTGGGGGGAGAAATTGAACTCAACGCAAAGGTCACCAGGTTGG ATACCCAAGGAGACAAAATAAGTGGCGTGACTTTGGCAGATGGTAGGCGGATTCCAGCTAG GGCCGTCGCATCCAACGCAGATGTGGTCCATACCTACAACAATTTGTTGGGTCATCATCCGA GAGGCGTTTCGCAAGCTGCCTCTCTTAGAAGAAAGCGCATGAGCAATTCCCTCTTTGTGTTG TATTTCGGGCTCAACCATCACCACTCCCAATTAGCCCACCATACGGTCTGTTTTGGACCACGT TATAAGGGGTTGATAGAAGACATTTTCAAGAGAGACAGCTTGGCAGACGATTTTTCCTTGTAT CTTCACGCTCCGTGTGTGACAGACCCTTCATTGGCTCCACCAGGATGTGGATACATACTACGT ATTGGCTCCTGTGCCACACTTGGGTACTGCAAACTTGAACTGGGATGTAGAGGGGCCACGAT TAAGAGACAGGATCTTTGAATACTTAGAGACAACACTATATGCCGGGTCTTAGAGATCAACTTG TTACACACCGTATGTTCACTCCGTTTGACTTTAGAGACCAATTAGGTGCCTACCACGGTTCCG CTTTCTCCGTTGAGCCAATCCTAACTCAATCTGCTTGGTTTCGCCCACACAACAGAGACTCTC GAATTGATAACCTTTATTTGGTTGGAGCTGGAACGCATCCCGGTGCAGGAATTCCGGGTGTC ATCGGGAGCGCGAAAGCAACGGCCGGCTTAATGTTGGAGGGCCACGCGTAA | 358 |
| CsCrtB | Chronobacter sakazakii | ATGAGTGACAAGCCTTTGTTAACACATGCTACAGAGACCATTGAGGCCGGATCAAAGAGTTT TGCGACCGCCAGTAAGCTCTTTGACGCCAAGCACACGTAGAAGTGCTCTTATGTTGTACGCTT GGTGTCGTCATTGCGATGACGTCACTGACGGTCAAGCCTTTGGGATTTAGGGCTGCAGACGC TCCTACAGATACACCACAGGCTCGTATCGCATTGTTGCGTGCTCTAACCTTGGAAGCGTATG CTGGTAAACCAATGCGTGAACCAAACTTTGCAGCTTTCCAGGAGGTTGCTCTAGCACATCAG ATCCCACCCGCATTGGCACTCGATCACTTGGAAGGGTTTGCGATGGATGTACGTGAAGAACG CTACCATACCCTTTGACGATACCCTAAGATACTGTTATCATGTTGCAGGCGTTGTTGGGTTGAT GATGGCTAGAGTTATGGGTGTCCGAGACGAGGCTGTCTTAGATAGAGCCTGCGATTTAGGTT TGGCTTTTCAGTTAACAAATATTGCCCGAGACATTGTCGAAGATGCGGCAATCGGACGATGC TATCTCCCAGAGGCCTGGTTGCAAGAAGAAGGACTTTGTGCGGATACATTGACTGACAGAGC ACACAGACCAGCTTTGGCTAGGCGCACGATTGGTGGATGAGGCAGAGCCATACTAT GCCTCAGCGAGAGCTGGATTGGCCGGACTCCCATTAAGGTCAGCTCGGGCCATCGCTACTG CCCACGGGGTTTACAGAGAAATCGGCGTAAAGGTGAAGAGGGCTGGTGTGAACGCGTGGG AAACGCGACAGGGAACGTCGAAGGCCGAGAAACTCGCCTTGTTGGCCAAGGGGCGGTGA TGGCAGTCTCCTCCAGAGGAGCCAGTTCAAGTCCACGACCTTCCGCGTTGTGGCAAAGACC ACGCGCTCAGGATGATCGGTACGCGCATGCCGCCCCTCCTGCCGCTTAA | 359 |

TABLE 24-continued

| Gene | Organism | C.V. Codon Optimized Sequence | SEQ ID NO |
|---|---|---|---|
| XdCrtE | Xanthophyllomyces dendrorhous | ATGGACTACGCCAACATCCTCACTGCCATTCCATTGGAATTTACGCCACAAGATGATATAGTT TTGTTGGAACCCTACCACTACCTCGGTAAAAACCCCGGGAAGGAAATCCGATCACAATTGAT TGAGGCATTCAACTACTGGTTAGATGTTAAAAAGGAGGATCTCGAGGTTATTCAGAATGTAGT CGGAATGTTGCACACAGCATCCCTTTGATGGATGATGTCGAAGACTCTTCTGTACTACGAC GTGGATCACCGGTCGCGCATTTGATTTACGGAATCCCACAAACCATTAACACCGCCAACTAC GTTTATTTCCTAGCTTATCAGGAAATATTCAAATTGAGGCCTACCCCAATCCCTATGCCAGTC ATCCCCCCATCGTCGGCCTCATTGCAGTCCAGCGTAAGCTCAGCTAGCTCCTCGTCATCTGC GTCATCGGAAAACGGGGGAACATCAACACCCAACAGTCAAATTCCATTCAGCAAGGACACCT ACCTTGACAAAGTAATCACCGATGAAATGCTTTCCTTGCACAGGGGCCAGGGCTTAGAACTT TTCTGGAGAGACTCGCTAACATGTCCCAGTGAGGAAGAGTACGTTAAGATGGTCCTTGGCAA AACAGGGGGCTATTCCGAATTGCTGTCAGGTTGATGATGGCTAAAAGTGAATGCGATATTG ACTTCGTTCAATTGGTCAATTTAATTTCGATATATTTCCAGATTAGAGATGACTACATGAACTT GCAATCGTCCGAGTATGCTCACAACAAGAACTTCGCGGAGGATCTAACGAGGGCAAGTTTT CATTCCCTACGATTCACTCGATTCACGCAAATCCATCAAGTCGTTTGGTCATCAACACTTTGC AAAAGAAGTCAACAAGCCCTGAAATCCTTCATCACTGTGTGAATTACATGAGAACTGAAACTC ACTCCTTTGAGTACACCCAAGAGGTATTGAACACACTCAGTGGAGCCTTAGAGAGAACTT GGTCGGTTGCAAGGAGAGTTTGCCGAAGCCAACAGCAAATCGACTTGGGGGATGTGGAAA GTGAAGGTCGCACAGGTAAAAACGTAAAACTTGAGGCAATCTTGAAAAAGCTTGCCGACATC CCATTATAA | 360 |
| XdCrtI | Xanthophyllomyces dendrorhous | ATGGGCAAGGAACAAGATCAAGACAAACCTACTGCCATTATCGTCGGTTGTGGTATAGGCGG CATCGCTACCGCCGCTCGTCTTGCTAAGGAGGGCTTTCAAGTCACGGTGTTCGAGAAGAAC GATTATAGCGGAGGCAGGTGTTCGCTAATCGAACGCGATGGTTACCGATTTGACCAGGGTC CGAGTTTGTTATTGCTCCCGGACTTGTTTAAACAAACCTTTGAAGACCTTGGAGAAAAGATGG AGGATTGGGTAGACTTAATAAAAATGCGAACCGAACTACGTTTGTCATTTTCATGACGAAGAGA CTTTCACCTTTAGTACGGACATGGCATTGTTGAAGAGAGAAGTCGAGAGATTTGAAGGAAAG GATGGTTTCGACAGATTCTATCCTTTATTCAAGAAGCCCACCGTCATTATGAGTTGGCTGTC GTGCACGTCTTACAAAAAAATTTCCCAGGTTTCGCTGCATTCCTTCGCCTTCAATTTATAGGC CAGATCTTAGCATTGCACCCATTTGAATGGACCCGCGTGTGCAGATACTTCAAGAC TGACCGCTTGAGAAGAGTTTTTTCGTTCGCAGTCATGTACATGGGTCAAAGCCCTTACTCAG CGCCGGGAACATATAGTTTGTTGCAGTACACCGAGTTAACGGAGGGAATATGGTACCCAAGG GGCGGTTTCTGGCAGGTTCCAAATACCTTGTTGCAAATTGTTAAACGAAACAACCCTTCAGCT AAATTCAACTTCAATGCACCAGTGAGTCAGGTCCTCTTGAGTCCTGCCAAAGACAGAGCAAC CGGAGTGAGGTTGGAGAGTGGCGAAGAGCATCACGCGGACGTTGTCATCGTCAACGCAGAC CTTGTTTATGCTAGCGAGCATCTTATTCCTGATGACGCTAGGAACAAGATTGGGCAATTAGGA GAGGTGAAAAGGTCTTGGTGGGCGGATTTGGTGGGAGGTAAGAAACTCAAAGGTTCGTGTT CTTCATTGTCATTCTACTGGTCCATGGACCGAATAGTGGACGGTTTGGGGGGTCACAATATC TTTTTGGCCGAGGACTTCAAGGGTAGTTTTGACACCATTTTCGAGGAACTAGGATTGCCGGC TGATCCTTCTTTTTACGTAAATGTTCCATCTCGCATCGATCCGTCAGCTGCCCCGGAAGGTAA GGATGCCATTGTGATACTAGTGCCATGTGGTCATATTGATGCCAGCAACCCACAAGATTACA ATAAGTTGGTTGCTAGGGCTAGGAAGTTCGTGATTCAGACATTGTCGGCAAAGTGGGACTTT CCAGACTTCGAAAAAATGATTGTTGCGGAAAAGGTGCACGATGCTCCGTCGTGGGAAAAGGA GTTCAACCTCAAGGATGGTTCAATCTTGGGTTTGGCGCACAACTTCATGCAAGTGCTCGGGT TCAGGCCGTCGACTAGACACCCTAAGTATGACAAACTCTTTTTTTGTTGGAGCTAGCACACATC CTGGTACAGGGGTTCCAATCGTCCTTGCTGGTGCCAAATTGACAGCTAATCAAGTGTTGGAG TCCTTCGACAGATCTCCAGCCCCCGATCCAAATATGAGCCTATCTGTTCCATACGGCAAGCC TTTAAAGTCGAACGGGACGGGCATCGATAGTCAAGTCCAGTTGAAGTTCATGGATTTGGAAA GATGGGTTTACTTGTTGGTTTTGTTAATCGGAGCCGTTATTGCCAGAAGCGTTGGAGTTCTCG CATTTTAA | 361 |
| XdCrtYB | Xanthophyllomyces dendrorhous | ATGACGGCATTGGCGTACTACCAAATCCACTTGATTTATACCTTGCCCATACTAGGGTTGTTG GGTTTGTTAACTTCTCCAATCCTTACCAAATTTGATATATATAAAATCTCTATCTTGGTTTTTAT TGCATTTTCAGCAACAACTCCATGGGACAGTTGGATAATTAGAAATGGGGCATGGACTTACC CTTCGGCCGAGTCGGGTCAAGGCGTCTTTGGGACTTTTCTAGATGTTCCATATGAAGAATAC GCTTTCTTCGTTATCCAAACGGTTATAACAGGTTTGGTCTACGTCCTCGCCACAAGGCATTTG TTACCATCGCTCGCCTTGCCAAAGACACGATCCTCGGCATTAAGCCTCGCGTTGAAGGCATT GATTCCGCTCCCAATTATCTATTTGTTCACAGCCCACCCAAGTCCTTCACCAGATCCCTTGGT TACCGATCATTACTTCTATATGAGGGCGTTGTCACTCTTGATCACGCCTCCCACCATGTTACT TGCTGCCTTGAGCGGGGAATACGCGTTCGACTGGAAGTCCGGCCGAGCAAAAAGCACGATT GCAGCTATCATGATTCCAACGGTATACCTAATTTGGGTCGATTACGTCGCAGTAGGACAGGA CAGCTGGAGTATCAACGACGAAAAAATCGTGGGCTGGCGCCTTGGGGGGGTCCTTCCTATA GAAGAGGCAATGTTCTTTTGTTGACGAATCTCATGATCGTGTTAGGGCTTTCAGCATGCGAC CATACTCAAGCCTTGTATCTTCTCCATGGTAGAACTATTTATGGTAATAAAAAAATGCCGTCGT CGTTCCCATTGATTACCCCGCCAGTGCTTTCTTTGTTCTTCTCAAGTAGACCGTATTCATCGC AACCCAAGCGTGATTTGGAATTGGCGGTTAAGTTGTTGGAAGAGAAATCCCGTAGCTTCTTC GTGGCAAGTGCCGGTTTTCAAGTGAAGTGAGAGAGAGGTTGGTGGGCTTATACGCGTTTT GCAGAGTCACGGACGACCTTATAGACAGTCCAGAAGTGTCCTCTAACCCACACGCGACGAT CGATATGGTTAGCGATTTTTTGACCTTGCTTTTTGGACCACCCTTGCACCCATCCCAACCAGA TAAAATTTTGAGCTCACCTCTACTCCCGCCCAGTCACCCAAGCAGGCCCACGGGGATGTACC CACTCCCCCCGCCACCGAGTTTGTCTCCAGCCGAATTGGTTCAGTTCTTGACGGAACGCGTT CCAGTGCAGTTCACTTTGCGTTCAGGTTGTTGGCGAAATTACAAGGGTTGATCCCAAGATAT CCGTTAGACGAGCTATTGAGAGGTTACACCACCGATTTGATATTCCCTTTGTCCACCGAGGC TGTGCAAGCCAGAAAAACCCCAATCGAGACTACGGCAGATCTTTTGGATTACGGTTTGTGCG TAGCGGGAGCGTCGCCGAGTTATTAGTCTACGTTTCGTGGGCATCCGCTCCATCACAGGTT CCAGCCACTATTGAGGAAAGAGAGGCCGTGTTGGTCGCTAGCAGAGAGATGGGTACAGCGT TGCAATTAGTGAATATTGCTCGAGATATTAAAGGTGATGCCACTGAGGGCCGTTTCTACTTGC | 362 |

TABLE 24-continued

| Gene | Organism | C.V. Codon Optimized Sequence | SEQ ID NO |
|---|---|---|---|
| | | CATTGAGTTTTTTCGGTTTGCGTGACGAATCAAAACTCGCAATACCAACAGATTGGACTGAAC<br>CTAGGCCACAAGACTTCGATAAATTGTTGTCGCTCTCCCCAAGCTCCACTCTTCCATCATCAA<br>ATGCGTCCGAATCCTTCAGATTTGAGTGGAAGACGTACAGTCTTCCCCTAGTGGCCTACGCC<br>GAAGACTTGGCGAAACACAGTTACAAGGGAATTGACCGTCTACCCACCGAGGTGCAGGCAG<br>GTATGAGGGCGGCGTGCGCCAGTTACCTTTTGATAGGGCGCGAAATCAAGGTTGTGTGGAA<br>GGGTGACGTAGGTGAGCGACGGACGGTGGCCGGTTGGCGAAGAGTCAGAAAAGTTCTTTCT<br>GTGGTTATGTCGGGTTGGGAGGGACAATAA | |
| PaCrtE | Pantoea ananatis | ATGACGGTGTGTGCTAAGAAGCACGTCCACTTGACTAGAGACGCCGCCGAACAATTATTGGC<br>CGACATTGACAGGAGACTTGACCAACTTTTGCCGGTTGAAGGTGAGAGGGATGTTGTGGGA<br>GCTGCAATGCGAGAGGGGGCTTTAGCCCCAGGTAAGAGGATAAGACCTATGTTACTTCTATT<br>GACAGCGAGGGATCTAGGTTGTGCTGTCTCACATGATGGTTTGCTAGATTTGGCCTGTGCGG<br>TCGAGATGGTCCATGCCGCCAGCCTCATCCTCGACGATATGCCCTGTATGGATGACGCTAAA<br>TTGACGCGTGGTCGGCCAACGATTCACTCGCACTACGGGGACATGTTGCAATCCTAGCCG<br>CAGTCGCCTTGTTGTCAAAGGCCTTCGGCGTTATCGCCGACGCCGACGGCTTGACGCCATT<br>GGCAAAAAACAGAGCGGTGAGTGAGTTGAGTAACGCTATAGGTATGCAAGGGTTGGTTCAA<br>GGACAATTCAAAGATTTGTCCGAGGGGGACAAGCCAAGAAGTGCTGAAGCAATTTTGATGAC<br>CAATCACTTCAAAACATCCACATTGTTCTGCGCATCTATGCAAATGGCATCCATTGTTGCAAA<br>CGCCTCATCGGAGGCCAGAGATTGTCTACATCGATTTTCTCTTGATTTGGGCCAAGCGTTCC<br>AGTTGTTGGACGACCTTACAGACGGTATGACCGATACTGGCAAAGATTCGAACCAAGACGCA<br>GGTAAAAGTACGTTGGTAAATCTCTTGGGTCCTAGAGCTGTCGAGGAGAGGCTTAGACAACA<br>TCTCCAGTTAGCATCCGAACATCTATCAGCTGCCTGCCAACACGGTCACGCCACTCAACACT<br>TTATTCAAGCGTGGTTTGACAAGAAGTTGGCGGCTGTAAGCTAA | 363 |
| PaCrtI | Pantoea ananatis | ATGAAACCCACAACCGTTATTGGTGCTGGCTTTGGCGGTTTGGCATTGGCCATAAGATTGCA<br>AGCTGCCGGCATACCTGTGTTATTGCTTGAACAGCGGGACAAGCCAGGAGGACGGGCGTAC<br>GTCTATGAAGATCAGGGTTTCACTTTTGATGCTGGGCCCACGGTTATCACAGACCCGTCGGC<br>GATCGAGGAACTTTTTGCCTTGGCTGGAAAGCAATTGAAAGAATATGTCGAGTTACTTCCAGT<br>TACACCATTTTATCGATTGTGCTGGGAATCCGGTAAGGTGTTTAATTACGACAACGACCAAAC<br>TAGGCTTGAGGCCCAAATCCAACAATTCAACCCCCGGGATGTTGAGGGTTATCGCCAATTCC<br>TCGACTATAGCAGAGCTGTCTTCAAGGAAGGGTACTTGAAATTGGGCACTGTGCCATTCTTG<br>TCTTTCCGAGATATGTTACGAGCAGCCCCACAGTTGGCGAAATTGCAAGCATGGAGAAGCGT<br>TTACAGTAAAGTTGCTTCTTATATTGAGGACGAACATTTGAGACAGGCCTTTTCATTTCACAG<br>CTTGTTGGTGGGAGGTAACCCATTCGCTACTAGCTCTATTTACACCTTGATTCACGCCCTAGA<br>AAGGGAATGGGGTGTTTGGTTTCCCAAGAGGTGGGACAGGCGCTTTAGTGCAAGGAATGATC<br>AAATTGTTCCAAGACTTAGGAGGGGAAGTGGTGTTGAACGCGCGTGTGTCTCACATGGAAAC<br>TACAGGGAACAAGATAGAAGCAGTGCATCTCGAAGACGGCCGTCGATTCTTGACACAAGCA<br>GTTGCATCGAATGCCGACGTCGTTCACACCTACCGCGACTTGCTATCTCAACATCCAGCCGC<br>TGTGAAGCAATCCAATAAATTACAAACAAAAAGAATGTCAAACTCCTTATTTGTTTTGTACTTC<br>GGTCTAAATCACCACCATGATCAACTCGCTCATCACACAGTCTGCTTCGGTCCAAGATATAGA<br>GAATTGATCGACGAGATATTCAATCATGACGGGTTGGCCGAAGATTTTCTTTGTATCTACAC<br>GCTCCATGCGTCACTGATAGCTCTCTCGCTCCTGAGGGGTGCGGTTCTTACTACGTTTTGGC<br>CCCTGTACCTCACTTGGGTACGGCGAACTTGGATTGGACCGTAGAGGGTCCCAAGCTACGT<br>GACAGAATCTTTGCATACTTAGAACAACACTACATGCCGGGGTTACGCAGCCAATTGGTTAC<br>ACATAGAATGTTCACGCCGTTGACTTCCGAGACCAACTAAACGCGTATCACGGCTCTGCTT<br>TTTCAGTTGAGCCAGTGCTCACGCAAAGCGCATGGTTTAGGCCTCACAACAGGGACAAAACG<br>ATCACTAACTTATACCTCGTGGGGGCCGGGACCCCACCCAGGAGCAGGAATACCAGGGGTCA<br>TTGGTTCGGCTAAGGCGACTGCCGCTTGATGCTTGAGGACTTGATTTAA | 364 |
| PaCrtB | Pantoea ananatis | ATGAACAACCCCTCATTGTTGAACCATGCCGTGGAGACAATGGCAGTCGGTTCTAAGAGCTT<br>TGCTACCGCATCGAAATTGTTTTGATGCCAAAACTCGGAGGTCAGTTTGATGCTCTACGCGT<br>GGTGTCGTCATTGTGACGATGTTATCGATGACCAAACCCTCGGCTTCCAAGCTCGGCAGCCG<br>GCATTGCAAACCCCAGAACAAAGGTTGATGCAATTGGAGATGAAGACCAGGCAAGCTTATGC<br>CGGCAGCCAGATGCACGAACCCGCCTTTGCGGCTTTTCAAGAGGTTGCAATGGCTCATGATA<br>TAGCCACCTGCTTATGCCTTTGACCACTTGGAGGGTTTCGCTATGGACGTCAGGGAAGCCCAG<br>TATAGCCAATTGGATGATACCTTAAGGTACTGTTATCATGTCGCAGGAGTTGTGGGATTGATG<br>ATGGCGCAGATCATGGGGGTTCGAGACAACGCTACCTTGGATAGAGCATGTGATTTGGGGT<br>TGGCGTTTCAATTGACTAATATCGCGCGAGATATTGTCGACGATGCACACGCAGGTAGATGC<br>TACTTGCCAGCCTCTTGGCTAGAACACGAAGGCCTCAACAAGGAGAATTACGCCGCCCCTGA<br>AAATCGACAAGCTTTGTCAAGAATAGCGAGAAGATTGGTGCAAGAGGCCGAGCCATATTATT<br>TGAGTGCGACAGCTGGTTTAGCCGGATTGCCATTGAGGAGTGCATGGGCCATAGCCACGGC<br>GAAACAAGTATACCGTAAAATAGGGGTCAAAGTCGAGCAAGCTGGTCAGCAAGCATGGGATC<br>AGCGGCAATCAACCACAACGCCAGAGAAGTTGACTTTGCTCTTGGCCGCCAGTGGACAGGC<br>TCTAACCTCCCGTATGAGAGCCCATCCCCCAAGGCCAGCTCACTTGTGGCAGAGGCCATTGT<br>AA | 365 |
| XdCrtR | Xanthophyllomyces dendrorhous | ATGGCAACCCTATCTGACTTGGTTATCTTGTTGTTGGGTGCCTTGTTAGCATTGGGGTTCTAT<br>AACAAGGACAGATTGCTCGGTTCAAGTTCCAGCAGTGCCTCTACCACATCAGGTTCAAGCGC<br>TGCAACTGCTAACGGTAGTAAGCCCACATATTCTAATGGCAACGGGAACGCCTTTAAAGGCG<br>ACCCACGAGATTTCGTCGCGAGAATGAAGGATCAAAAGAAAAGGTTGGCAGTTTTTTATGGG<br>TCCCAAACTGGAACTGCTGAGGAGTACGCCACCCGAATCGCCAAGGAAGCGAAATCTCGTTT<br>CGGCGTTTCGAGTTGGTGTGTGACATTGAGGAATATGATTTTGAAAAATTGGATCAAGTCCC<br>CGAGGATTGCGCCATTGTTTTTGCATGCGTACCTATGGTGAAGGTGAACCAACAGACAATG<br>CTGTCCAATTCATCGAAATGATCAGCCAGGATGACCCAGAGTTTAGTGAAGGTAGTACTTTG<br>GATGGTTTGAAGTACGTTGTCTTTGGATTGGGGAATAAGACATACGAGCAATACAATGTTGTC<br>GGCCGGCAGTTGGACGCTAGATTAACCGCACTTGGTGCGACCAGAGTAGGTGAGCGAGGT<br>GAAGGAGATGATGACAAAAGTATGGAGGAAGATTATCTCGCATGGAAGGATGATATGTTCGC | 366 |

TABLE 24-continued

| Gene | Organism | C.V. Codon Optimized Sequence | SEQ ID NO |
|---|---|---|---|
| | | CGCTTTGGCCACCACATTAAGTTTTGAAGAGGGAGCTTCGGGGGAGACTCCAGATTTCGTGG TCACTGAAGTCCCGAACCACCCCATCGAAAAGGTCTTCCAGGGCGAATTGTCCAGCAGAGC CTTGTTGGGCTCTAAAGGCGTTCACGACGCCAAGAATCCATACGCTTCGCCAGTTTTGGCCT GCCGGGAATTATTCACAGGCGGAGATCGAAACTGTATCCACCTTGAGTTTGACATCACCGGG TCCGGAATCACCTACCAAACAGGTGATCACGTCGCAGTTTGGCCATCCAATCCTGACGTTGA AGTGGAAAGGCTTTTGGCAGTGTTGGGTCTCACATCTCCAGAGAAGAGACGGATGATTATCC AAGTGGTGAGCCTTGATCCAACTTTGGCCAAGGTTCCATTCCCTACACCAACCACCTATGAT GCCGTTTTCAGACATTACCTTGACATTAGTGCAGTGGCTTCACGCCAGACCTTGGCTGTCCT TGCCAAATACGCCCCTTCCGAACAGGCTGCCGAATTCTTAACCAGGTTGGGAACTGACAAGC AAGCGTACCATACTGAAGTGGTTGGAGGTCACCTAAGATTGGCCGAGGTGCTTCAATTGGT GCAGGGAACGATATTACTGTTATGCCTACAGCTGAAAATACAACCGTCTGGAACATACCATTC GACCACGTTGTGTCTGACGTTTCCCGCTTGCAACCCCGATTTTACTCGATAAGCAGTTCTCCT AAGCTTCACCCGAACAGCATTCACGTAACGGCTGTGATACTTAAATACGAAAGTCAAGCCAC TGACCGTCACCCAGCGAGATGGGTGTTTGGTTTGGGGACAAACTATTTGCTTAATGTTAAGC AAGCAGCAAACAATGAAACCACTCCAATGATCTCTGACGGACAAGACGATGTGCCAGAACAC GTGTCAGCGCCAAAATACACGTTGGAGGGACCCCGTGGCTCCTATAAGCACGACGATCAATT GTTTAAAGTGCCAATCCATGTGCGTAGGTCCACTTTCAGACTTCCAACCAGCCCTAAGATCC CTGTGATCATGATTGGGCCAGGTACCGGTGTCGCTCCTTTCAGAGGATTCATCCAAGAAAGA ATTGCCCTTGCCAGAAGGTCCATTGCTAAGAATGGGCCTGACGCCTTGGCGGATTGGGCCC CAATCTATCTTTTCTACGGTAGTCGCGATGAGCAAGACTTCTTGTACGCGGAAGAGTGGCCT GCTTATGAAGCGGAGTTGCAAGGGAAATTCAAGATTCATGTTGCTTTCAGTAGATCCGGGCC AAGAAAGCCAGATGGGAGTAAGATTTACGTGCAAGATCTTTTGTGGGATCAAAAGGAAGTCA TCAAATCTGCCATAGTGGAAAAACGTGCATCTGTTTATATTTGTGGGGACGGTCGAAATATGT CGAAAGATGTCGAGCAGAAGTTGGCCGCGATGTTGGCCGAAAGTAAAAACGGTAGTGCGGC CGTGGAAGGAGCCGCGGAAGTCAAGTCATTGAAAGAGAGATCTCGATTATTGATGGATGTGT GGAGCTAA | |
| XdCrtS | Xanthophyllomyces dendrorhous | ATGTTCATTTTGGTGTTGTTGACCGGTGCTTTGGGTTTGGCAGCTTTTAGCTGGGCTTCGATT GCCTTCTTTTCTCTTTATTTGGCGCCCCGTCGCAGTAGCTTGTATAATTTGCAAGGTCCAAAC CACACTAACTATTTCACCGGCAATTTTTTAGATATACTCTCGGCTAGGACGGGTAGGAGCAT GCTAAGTATAGGGAAAAATACGGATCCACGTTGAGATTTGCCGGCATCGCCGGTGCCCCAG TTTTGAACTCAACTGATCCAAAGTCTTCAACCATGTGATGAAGGAGGCATATGATTACCCAA AACCTGGTATGGCTGCGAGAGTGTTGAGGATTGCAACGGGTGACGGAGTGGTTACGGCTGA GGGTGAGGCACATAAACGACATCGAAGAATCATGATCCCTTCCTTGTCAGCACAAGCCGTTA AGTCCATGGTTCCCATCTTCCTTGAGAAGGGCATGGAGCTCGTTGACAAGATGATGGAGGAC GCAGCCGAGAAAGACATGGCAGTGGGCGAATCCGCAGGTGAGAAGAAGGCTACTCGACTTG AAACGGAAGGCGTTGACGTAAAGGACTGGGTTGGGAGAGCAACTTTGGATGTCATGGCTTT GGCCGGATTTGATTACAAATCAGATTCGCTACAAAATAAGACGAACGAATTGTATGTCGCTTT CGTGGGGCTTACAGACGGATTTGCACCCACCTTGGACAGTTTTAAGGCCATCATGTGGGATT TCGTGCCGTACTTTCGCACAATGAAGAGAAGACATGAGATTCCCTTGACCCAGGGTTTGGCT GTTAGTCGCCGTGTTGGCATTGAACTAATGGAGCAAAAGAAGCAAGCAGTGTTGGGTTCGGC ATCGGATCAAGCCGTGGACAAAAGGACGTGCAGGGACGCGACATTCTTAGTCTCTTGGTCA GAGCGAACATTGCCGCAAATCTTCCCGAATCTCAAAAGTTGTCGGACGAAGAGGTTCTTGCT CAAATTTCGAATTTGCTATTCGCGGGTTATGAGACTTCAAGTACTGTTCTCACATGGATGTTC CATCGATTGTCGGAGGACAAAGCAGTGCAAGATAAATTAAGGGAGGAAATCTGTCAAATAGA TACAGACATGCCAACACTAGACGAGTTGAATGCATTGCCGTACTTGGAGGCGTTTGTGAAAG AGTCACTAAGACTCGATCCCCCGTCTCCATATGCTAATAGGGAGTGTTTGAAGGATGAAGAT TTCATTCCATTGGCCGAACCTGTCATTGGACGCGATGGGTCCGTGATCAATGAAGTCAGAAT CACAAAGGGGACAATGGTGATGCTTCCATTGTTCAACATCAATAGATCGAAATTCATATACGG TGAGGACGCCGAAGAATTTAGACCAGAAAGGTGGTTGGAGGATGTTACCGACTCCCTTAACA GCATAGAAGCTCCATATGGCCATCAAGCGTCCTTCATATCAGGACCAAGAGCCTGCTTTGGA TGGCGGTTCGCGGTCGCAGAAATGAAAGCATTCTTGTTCGTAACACTAAGGAGAGTGCAATT TGAGCCGATCATAAGCCATCCAGAGTACGAACATATTACTCTCATTATCAGCAGACCCCGGA TCGTTGGCAGAGAGAAGGAAGGATATCAGATGCGTTTGCAGGTAAAGCCAGTGGAGTAA | 367 |
| AaCrtZ | Agrobacterium aurantiacum | ATGACAAACTTCTTGATCGTTGTGGCCACCGTGCTTGTTATGGAATTGACCGCCTACTCGGT GCATAGATGGATAATGCACGGACCATTGGGTTGGGGATGGCACAAATCACACCATGAGGAA CACGATCACGCCTTAGAAAAAATGACCTCTATGGCTTGGTGTTCGCTGTCATTGCGACCGT TTTGTTCACCGTCGGTTGGATCTGGGCACCAGTGTTGGTGGATTGCACTTGGTATGACGG TTTATGGCCTCATATATTTTGTGCTCCACGATGGTCTAGTTCACCAAAGGTGGCCTTTCAGAT ACATTCCCAGGAAGGGTTATGCACGGCGATTATATCAAGCCCATCGTCTTCATCACGCTGTG GAGGGAAGGGATCACTGTGTCAGCTTTGGGTTCATCTACGCACCACCCGTTGACAAGTTGAA ACAAGATTTGAAAATGTCTGGTGTCTTGCGGGCTGAGGCCCAAGAGAGGACGTAA | 368 |
| AaCrtW | Agrobacterium aurantiacum | ATGAGTGCCCATGCCTTGCCAAAGGCAGATCTAACTGCCACTAGTTTAATTGTGTCGGGCGG TATTATCGCGGCTTGGTTGGCATTGCATGTACATGCATTGTGGTTCTTGGACGCGGCAGCGC ACCCTATCCTCGCAATCGCCAATTTTCTTGGACTAACGTGGTTGTCAGTAGGTCTATTTATCA TCGCCCACGATGCGATGCACGGATCCGTAGTCCCTGGTAGACCTAGAGCCAATGCTGCAAT GGGCCAGTTGGTGCTTTGGTTGTACGCTGGCTTCAGTTGGAGAAAGATGATTGTTAAGCATA TGGCACATCACCGTCACGCAGGTACCGATGACGACCCAGATTTTGATCATGGAGGTCCAGT GCGATGGTACGCACGCTTCATAGGAACCTACTTTGGCTGGAGAGAAGGTTTGCTTTTGCCAG TCATAGTAACCGTCTACGCTTTAATACTTGGAGATCGAGGATACGTCGTGTTCTGGCCAT TGCCATCAATCTTGGCCTCTATCCAATTGTTCGTTTTGGGACTTGGTTACCACATAGACCCG GTCACGATGCATTCCCAGATAGACACAACGCCCGATCATCCAGAATATCCGATCCAGTTCTT TGCTAACTTGCTTCCACTTCGGTGGTTATCACCACGAACACCATTTGCATCCGACGGTCCCAT GGTGGAGGTTGCCTAGCACTAGAACTAAAGGTGATACCGCTTAA | 369 |

TABLE 24-continued

| Gene | Organism | C.V. Codon Optimized Sequence | SEQ ID NO |
|---|---|---|---|
| CnTPS1 | Callitropsis nootkatensis | ATGGCAGAAATGTTCAATGGAAACAGCAGTAATGACGGGAGCTCATGTATGCCGGTAAAGGA TGCATTGAGACGTACGGGCAACCACCACCCAAATTTGTGGACTGACGATTTCATTCAATCGC TTAATAGTCCATACTCGGACTCCTCCTACCATAAACATCGCGAAATATTGATCGATGAGATTC GCGATATGTTTTCAAATGGGGAAGGGGACGAATTTGGCGTGTTGAAAATATTTGGTTTGTC GATGTTGTTCAACGGTTAGGAATCGACCGTCACTTTCAGGAAGAGATTAAAACAGCGTTGGA CTACATCTACAAGTTTTGGAACCACGACTCGATATTTGGTGACCTTAACATGGTCGCTTTGGG TTTCAGAATCCTAAGATTGAACCGTTACGTGGCAAGCAGCGACGTTTTCAAGAAGTTTAAGG GTGAAGAGGGCCAATTTTCAGGCTTCGAAAGTTCAGACCAAGATGCGAAGTTGGAAATGATG CTAAACTTGTATAAAGCAAGTGAGCTAGATTTTCCAGACGAGGATATCCTTAAGGAAGCTAGG GCCTTTGCGAGTATGTACTTAAAGCACGTAATCAAGGAATACGGTGATATCCAAGAGGAGCAA GAACCCATTGCTTATGGAGATAGAATACACATTCAAGTACCCATGGCGTTGTCGTTTGCCTCG ACTTGAGGCTTGGAATTTCATTCACATTATGAGACAACAAGACTGTAATATTTCATTGGCTAAC AACCTTTACAAGATTCCGAAGATATACATGAAAAAGATCTTGGAGTTGGCCATCTTGGACTTT AATATTCTCCAGTCACAACACCAACATGAAATGAAACTCATCTCCACGTGGTGGAAGAACTCT AGCGCTATCCAATTGGACTTTTTCAGACACCGCCACATCGAAAGCTACTTCTGGTGGGCTTC ACCGTTGTTCGAGCCCGAGTTTTCTACATGTCGGATCAACTGTACGAAGTTGTCAACTAAAAT GTTTCTACTTGACGATATATACGACACATACGGTACTGTGGAAGAACTAAAGCCGTTTACGAC CACATTAACGAGGTGGGACGTGTCTACAGTCGACAACCATCCAGACTACATGAAGATCGCTT TTAACTTCAGCTATGAAATCTACAAGGAGATCGCCTCCGAGGCGGAACGTAAACACGGTCCA TTCGTGTATAAATATTTGCAATCATGCTGGAAGTCCTATATAGAAGCTTACATGCAAGAAGCA GAGTGGATTGCTTCAAATCATATTCCAGGCTTCGATGAGTACCTCATGAATGGTGTAAAGTCA TCCGGCATGAGAATATTGATGATCCACGCATTAATCCTAATGGATACACCATTGAGCGACGA GATTTTGGAACAATTAGATATACCGAGTTCGAAGTCACAGGCCTTGTTGTCGTTGATTACCAG ACTCGTGGATGATGTCAAGGACTTTGAGGACGAACAAGCCCATGGGGAAATGGCATCCTCC ATTGAATGTTACATGAAAGATAACCACGGTTCAACAAGAGAAGATGCATTAAACTACTTGAAG ATCCGAATCGAGTCGTGTGTCCAGGAGTTGAATAAGGAATTGTTAGAACCTTCGAATATGCA CGGTAGTTTTAGGAATCTTTATTTGAATGTTGGCATGCGTGTCATATTTTTCATGCTCAACGAT GGGGACTTGTTCACTCATTCGAACAGGAAGGAAATTCAGGATGCCATCACCAAGTTCTTCGT CGAACCGATTATACCTTAA | 370 |

TABLE 25

| Gene | Organism | Native Cv sequence | SEQ ID NO |
|---|---|---|---|
| ERG10 | Candida viswanathii | ATGACCCTCCCACCAGTCTACATCGTCTCCACAGCAAGAACTCCAATTGGTTCCTTCCAAGG TTCGTTATCTTCCTTGACCTACTCCGATTTGGGTGCCCACGCCGTTAAGGCAGCTTTAGCCAA GGTCCCACAGATCAAGCCACAGGACGTCGACGAGATCGTCTTTGGTGGTGTCTTGCAAGCC AACGTTGGTCAGGCACCAGCCAGACAAGTCGCCTTGAAGGCAGGCTTGCCAGACTCTATCA TTGCCTCCACCATTAACAAAGTCTGTGCCTCCGGTATGAAGGCCGTCATTATCGGTGCCCAA AACATCATCTGTGGAACCAGTGACATCGTCGTTGTTGGTGGTGCCGAATCCATGTCTAACAC TCCATACTACTTGCCAAGCGCCAGAAGCGGGGCCAGATACGGTGACGCCGTCATGGTTGAT GGTGTCCAGAAGGATGGTTTGTTGGATGTCTACGAAGAAAATTGATGGGTGTTGCTGCTGA AAAGTGTGCCAAGGACCACGGATTCAGCAGAGAAGAACCAGGACAACTTTGCCATCAACTCTT ACAAGAAGGCTGGCAAGGCTTTGAGTGAAGGTAAGTTCAAATCAGAAATCGCCCCAGTCACC ATTAAAGGATTCAGAGGCAAGCCAGATACTGTTATTGAAAATGATGAAGAGATTGGCAAATTC AACGAAGACAGACTCAAGTCTGCCAGAACTGTCTTCCAAAAGGAAAACGGTACTGTTACTGC TCCAAACGCTTCTAAATTGAACGATGGTGGTGCTGCCTTGGTCTTGGTTTCTGAAGCCAAGTT GAAGCAATTGGGCTTGAAGCCATTGGCCAAGATCTCTGGTTGGGGTGAAGCTGCCAGAACT CCATTCGATTTCACCATTGCCCCAGCTTTGGCTGTTCCAAAGGCTGTCAAGCACGCTGGTTT GACCGTTGACAGAGTCGACTTCTTTGAATTGAACGAAGCCTTCTCCGTTGTTGGTTTGGCCA ACGCTGAATTGGTCAAGATCCCATTGGAAAAATTGAACGTCTACGGTGGTGCTGTCGCCATG GGTCACCCATTGGGTTGCAGTGGTGCTAGAATTATTGTCACCTTGTTGTCCGTCTTGACCCA AGAAGGCGGTAGATTTGGTGCTGCTGGTGTCTGTAACGGTGGTGGTGGTGCCTCTGCCATC GTCATTGAAAAGATTGACTCCGATGCCAAGTTGTAA | 371 |
| ERG13 | Candida viswanathii | ATGACTAACGCACCACAAAACATTGGTATCAAAGGAATCGAAGTCTACATTCCAGGCCAAGC TGTCAATCAATCAGACTTGGAAAAATTCGACGGCATCCCAGCCGGCAAGTACACCATCGGCT TGGGCCAGACAAACATGGCTTTTGTCAACGACAGAGAGGACATCTACTCCATCGCCTTGACT GTTGTCTCCAGATTGATCAAGCATTACAATGTTGACACCAACAACGTCGGTCGTTTAGAGGTC GGTACCGAGACCTTGTTGGACAAGTCCAAGTCTGTCAAGTCCGTGTTGATGCAATTGTTCCC CGACAACAACGACATTGAAGGTATCGACACTGTCAACGCCTGCTACGGTGGTACCTCCGCTG TCATCAATGCCATCAACTGGATCGAGTCGTCTTCCTGGGACGGCAGAGACGCCATTGTTGTT GCTGGTGACATTGCTATCTACGACAAGGGTGCTGCTAGACCAACTGGTGGTGCTGGTTCCAT TGCTATGTTGATTGGTCCTGACGCTCCTATTGTGTTTGACTCTGTCGTGGCTCATCATGGA ACACGCCTATGATTTCTACAAGCCAGACTTCACCAGTGAATACCCAGTTGTCGATGGTCACTT CTCCTTGTCCTGTTACGTTAAGGCTGTTGACAACTGTTACAAGAACTACTCCAAGAAGGTCAC CGGCAACGTCGACAAGACCGTCGGCGTTTACGACCACTTTGACTACAACGCTTTCCACGTGC CAACCTGTAAGTTGGTCACCAAGAGTTACGCCAGATTGTTGTACAACGACTACAAGTCGGAT CCATCCAAGTTTGCTGACTTGATTGACGAAAGCACCAGACAACACATTGACAGTTTGTCCTAC GAAGCATCCTTGACCGACAAGGTCTTGGAAAAACTTTCGTCACATTGGCCAAAGAAGAGAC CAAAAAGAGAGTGCAACCAGCCTTGCAAGTGCCAACCAACACCGGTAACATGTACACTGCTT CGTCATGGGTCTCCTTGGCCTCGTTGTTGTACTATGTTGGCGCTGAAAACTTGAAAGAAAAG AGAATCGGTCTCTTCTCCTACGGTTCAGGTTTGGCCTCCACCTTGTTGTCCGTCACTGTTGTC | 372 |

TABLE 25-continued

| Gene | Organism | Native Cv sequence | SEQ ID NO |
|---|---|---|---|
| | | GGCGACGTTTCTCCAATCACCAAGGTCTTGGACTTCGACTACAAATTAGGCGAAGGAAGAAA GATCCAGAGCCCAGAAGAATACTTGGCTGCCATTGAATTGAGAGAAAAGGCACACTTGCAAA AGAGCTTCAAGCCACAAGGTTCCCTCGATAACTTGAGCCAAGGCACCTACTACTTGACTGAG GTTGACGACAAGTTTAGAAGAAGTTATGCTATAAAGGAATAA | |
| HMG1 | Candida viswanathii | ATGCTAAGTTTCATCACCGAAGCAAGTGGCAGAATAGCCCAGACTGCAGCCCACAGACCAAT TCACTTCATGGTGATACCTGCGTTACTAGCATCCATAGCATACTTGTCCATCATCGATGATTA CGTCCCCGAACACATCAGAGCCCAGTACATGTCAGGCGTCAGCTATTTCCACCCTCAAGGGT CCGCCTCGGATTTGGACAAGTGGATCGAAATTCCACGACACTACCCAATACGCCAACGCCAAC CAAATCAGTGTCATCCCTTTGAGATTCAGACGATTCCATGACTCAATCCCACAGATCGCTAAC GCCATCAAGATTTCAAACAATGAACAGATCTTGATTGTTCCTTCGGATAAAGCAGAGTCGACA GTAGAAGGTTTGAGCGAGATCACTGAGAATGGCATCACTTGGAGGGCTAGAAATAACGACAA GTTGTCCAAGTATTATGATTACGCCAGGTACGGGTTGCTTAGAATCCAGGACGCTATACACA ATGCTGATAATTTCGACATCCTCTTGGTGTTTGTTGCCTACCTTGGAATGTGGTACTCACTTAT CAAAGTGTTTATTGACATGAGACGCATTGCTCCAAGTTTTGGTTAGCCTTTGGCACGTTGAC TTCCTCGACTTTTTCATTCTTGTTTGCCTTGGTCATTTCAAACAAATTTTTGGACGCTAAAGTTT CCTTGAGAAGTCTTTCTGAATGCATCCCATTTTTGGTTGCCATTATTGGGTTCAAACATAAAGT GGCCATCACGACTAGTGTTGCCCAGTCATCCACTTCTTCACCCGAGGATGTTCCTCATGTCG TGGGCAAAGCTGTCTCAGACCAGTGTTTGTTTATCTTGAGAGACCATTTGGTTGTCATTATTG GATTTCTCGCCTGTGCGGCTTATGGCAATGAATTGAAAGGTTTAAGAAACTTCTGTATCTTGG GGGCATTGATTTTGTCCTTTGACATTGTTTCCGTTTATACTTTCTTTTCTGCGATTTTGGCCTT GAAAGTCGAGATTAACCGTGCCGCCGTACTCAAGATTTACAACACGTATTGGAAGAGGACG GCATTTCATCCTTAGTTGCCGCTAGAGTTGCCGAACGAAATGCAACTATTGAACACCCCAAC GAAACCAACTTCTTCTCATCTAATAATTCTTCCATTGTTTATTTCAAAGTTATTATGAGTCTTGG GTTTTTTCGCCTTCCATGCATTTTGGTTGGGCAGCTCGTGGTTATACAACACTTCTGATGGCGG TAGCCATGGAAGCTTTTCGTTCCTCAGCAACATCCCATTATTGACACAAGACATCTCCAACTC CATCCCAATTGGCAGAAGAGGAACCGTGGTTACCATTTTGCCAACCACCTTCTACATGCCAT CCGGTATCATCATCCAATTTGAAGATATGGTCTACTTAGCATTGAGCAAGATCAGCAGTGCTA TCAGAGACAGTTTGATTTCCAAGTGTATTGTGTTTGCATTGACCATTTCCATTGTCACCAACAT CTACTTCTTGAATGCTGCCCGTTTCCAAGTTTCAGCTACCCGTAAGTTGATTGACCAAGAAAT GTCTCGTCCAAAACAAGCCGCCGCCGCCGCTGCTGCTGCTCCATCTGCTGCAAAATCAGTG GCGCCAGAAGAAGACGAAGACGAAACCTCCAGTGAAGAACTTGAAATCAAAGCTCCTGTAAA GCCGTTATCACTTGAAGAATGTACCAGAATCCTCAAAGAGGGCAAAGTCAAGACCTTGTCCA ACGCTGAAGTGTCTAGCTTGGTTGTTGGCGGTAAATTGCCATTGTACGCTTTGGAGAAACAA TTGGGCGACAACAAGAGCCGTGGCGTTCGTCGTAAGGCTATTGCAAAATTAGCTAACGC GCCAGTATTAGAAACCAACCGTTTGCCTTACTCCCACTATGATTATGATAGAGTCTTTGGTGC TTGTTGTGAGAATGTTATTGGGTACATGCCAATCCCTGTTGGTGTTGCTGGACCATTAGTGAT TGATGGCAAGCCATACCACATCCCCATGGCCACTACCGAAGGTTGTCTTGTTGCCTCTACTA TGCGTGGCTGTAAAGCTATTAACGCTGGAGGTGGTGTTGAAACCGTCTTAACCAAAGATGGT ATGACTAGAGGTCCTTGTGTTCGTTTCCCAACTTTGAAAAGAGCCGGTGCTGCAAAGTTGTG GATTGACTCCGAAGAAGGTCAAATCACCATCAAAAAGGCATTCAACTCGACTTCTAGATTTGC TCGTTTGCAACATATTCAAACTGCCCTCGCTGGTACCTCGTTGTTTATTAGATTTAGAACTACT ACTGGTGATGCTATGGGCATGAACATGATTTTCCAAAGGTGTTGAATATTCCTTGAAGCACATG GTTGAAGAATGTGGCTGGGACGATATGGAAGTTATCTCTGTTTCTGGTAACTACTGTACCGAT AAGAAACCAGCTGCTATTAACTGGATTGAAGGTAGAGGTAAGTCTATTGTTGCTGCTGCTACC ATCCCTGCTGATGTTGTCACTAAAGTCTTGAAATCCGATGTCGATGCCTTAGTTGAATTGAAT GTTTCCAAAAACTTGGTTGGCTCAGCCATGGCCGGTTCAGTTGGTGGTTTCAATGCTCATGC AGCCAACTTGGTCACTGCTGTTTACTTGGCCTGTGGTCAAGACCCCGCACAGAATGTCGAAT CCTCAAACTGTATTACCTTGATGGAAAAGGACAAACAGACTGGCGACTTGGTCATTTCTGTTT CTATGCCATCTATTGAAGTTGGTACGATTGGTGGTGGTACCATTTTGGAACCACAAGCAGCC ATGTTGGACTTGTTGGGCGTGCGTGGCCCTCACCCAACCAATCCAGGTGACAATGCAAGAC AATTGGCCAAGATTGTTGCTTCGGCAGTGTTAGCAGCTGAATTGTCACTTTGTTCTGCTTTGG CCGCTGGTCACTTGGTGCAATCCCACATGCAACACAACCGTAAAGGAGCACCCCAGCTGC GGCCCCTGCAATCAGCAACGGAAGTGCCAAGGGAACCAAAACCAATGGGTCTATAAATGGG AAAGACTTGAAGCGTCTCAAAGACGGATCCGTTACATGTATAAAGTCATAG | 373 |
| ERG12 | Candida viswanathii | ATGTCAGTCTCGCCTTTCGTTGTCAGTGCTCCAGGGAAAGTCATCATCTTTGGAGAACATTCA GCAGTTTATGGGAAACCCGCCATTGCAGCCGCCTTGAGTTTGCGATGTTACCTACTCGTTTC CCCGTCAGTTGATGATGCAAACACAATCAGATTGCAGTTCCCAGACATCCAATTGGACCATTC CTGGAACATCAACGATATCCCCTGGGATGAAATCAAACCGTTCGTTAAATATGACGCCAATAA CAAACCACTCACCCCATCGGAGTTGGTACCAGAGATCCTCGATAAGTTGTCTCCCTTGTTGA CTGATTTCGATAACAAAATGCATTACTACGCTTGTTTTTGTTCCTTTACTTGTACGTCAATTTA TGTTCCACTGAAACTCCAGGAACCACCTTCATCGTCAGATCCACCTTGCCAATCGGTGCCGG GTTAGGGTCGTCTGCATCCACGTCTGTGTGCTTGTCGTCTGCATTAGCATTGTTAGGCGGCT GTATCAGTGAGCCTTGATATCAGCCACCGACAAGATCCTCAACGAAGCATACCCGATTTG GAGTTCGTCGATAAGTGGTCCTTGATAGGTGAGAAGTGCTTCCACGGGAACCCATCCGGTAT CGACAACGCAGTAGCCACGTTTGGCGGTGCCGTCATGTTTCAAAGAACTTCGGCTCCTGAG CAACCATCCATCAGAACCAAACATGAGAAACTTCCCAGCTATCAAACTCTTACTTACAAACACC AAAGTCCCAAAAAGTACAGCTGATTTAGTCGCCGGTGTTGGCAAACTCAACGCGGAGTTCAA CCCGGATAACCACGTCGATTTTGACCGCTATGGAGCATTTGTCACAGGAAGCTTACAAGTCA TGATCACTCCGGGGTTCGGCAAGGACGAAACAAACACGTTGCGTAAGTTGGTCAATATCAAC CATGGTCTATTGGTAGCGTTGGGCGTGCACCTCCGTCGCTAGAAACCGTCAAGATCATTGG TGACAGACACAAGATTGGCGCTACTAAGTTGACTGGCGCTGGTGGTGGCGGGTGTGCGATC ACTTTGGTTAATGATAATGTCGAGGAGTCTGTTATCCAAGAAGCTATCAAAGAGTTTGCAACT GAGGGATATGAGAGTTTTGAAACGTCGTTGGGTGGTAAAGGTGTCGGTGTCCTATTTAGTGG TGATGTTTCTGATAATGGCAAGTTTTCTCAATCTGTGTTCTGCAACTATCCCGACCGTGCTAG CATTGAAGATGCTTTAGGAATGATAAACGTTAAAGAATGGAAGTTCTGGTGA | 374 |

TABLE 25-continued

| Gene | Organism | Native Cv sequence | SEQ ID NO |
|---|---|---|---|
| ERG8 | Candida viswanathii | ATGTCAAAAGCTTTTAGTGCCCCTGGTAAAGCATTGTTAGCTGGCGGATACTTGGTTCTTGAG CCAACATATGATGCATATGTGACGGCATTGTCCTCGAGAATGCACGCTATAATAACACCCCA GAAGCCAGCATCCATTTCAAAAATCAAATCAGTTCGCCTCAGTTTGCCAATGGTGAGTGGG AGTATCACGTCACGTCTAATGAGAAACCCAAGGACATCAAGTCCAGAAGCAATCCGTTTTTG GAGGCTACCATTTTCATTGTTTTGTCTTATATCCAACCAACAGAACCATTCGATCTCGATTTGG TCATATATTCAGACCCAGGATACCATTCACAAGAACACACCACGCAGAAAGTGTCCAGCAAC GGCAAGAAAAAGTTCCTTTATCATTCGCGTGCAATTAACGATGTTGAGAAGACAGGATTAGGT TCTTCGGCCGGTCTAGTTTCTGTCGTCACTACCAGTTTGTTATCCTACTTTATTCCGGGAATT GAAGAGTCAAACAAGGACATGTTGCACAATGTAGCACAGATTGCCCATTGTTTTGCCCAGAA GAAGATTGGGTCCGGGTTCGATGTGGCCACTGCCATCTATGGTCTGATTGTCTACCGAAGAT TCCAGCCAAGCTTGATCAACGACGTTTTCGAGATCTTAGAGGAAACCCCGGGTAGATTCCCC GGTGCTTTGAAGTCGTTAGTTGAGTCTAATTGGGAATTCAAACATGAAAGGTGCGTACTACCA CCAAAGATCAAGCTCTTGATGGGAGATATCAAAGGAGGATCAGAGACTCCGAATTGTTTC CAAAATACTCCAATGGAAGAAGGACAAACCAGAAGAAAGTGGGTTGGTGTATGATCAACTTA ATAGCGCAAATGTGGCCGTTCATGAAGAAGATCAGTACATTGATGAATCGAGTCAGGTCCAA GAGATTGACGAATTGTCTGATTACATAAGCGCGGTACGCAAAGGGTTGCAAGAATTGACAGA AAAATCCAAAGTCCCAGTTGAACCACCTGTGCAAACTGAATTGTTGGACCGCATTGCAAAACT CCCAGGTTGTCTAGGTGGGGTTGTGCCCGGTGCTGGTGGGTACGATGCTATAGCTGTGCTT GTGTTGGAAAAGGAGGTTGAGAACTTTAGAAAAAGACACTTGAAAACCCAGAGTACTACCA CAACGTGTACTGGGTTGACTTGGAGGAAGAAACCGAGGGTGTAGTGGTGGAAAACTGGGAG GACTATATCGGTTTATAG | 375 |
| MVD1 | Candida viswanathii | ATGTATTCAGCTTCAGTCACAGCACCTGTCAACATAGCGGTATGTATGTTCCCACCTAGTTGC TCCTCCCGACTCATCACTAACACCCTTATAGACCCTCAAGTACTGGGGGAAACGCGACAAG ACCCTAAACTTGCCAACCAACTCCTCCATATCAGTCACCCTCTCCCAGGATGATTTGCGAACC TTAACCACAGCAGCAGCGTCCACCACTTTCGACAAGGACCAATTGTGGCTCAATGGCAAGTT GGAGTCGTTGGACACTCCGAGAACGCAAGCGTGCTTGGTCGATTTAAGGAAATTGAGAGCC GATGTTGAGCAAGCCAACGCTGACCTCCCAAAGCTTTCCACGATGAAGCTCCACATTGTTTC GGAAAACAACTTCCCCACCGCCGCTGGTTTGGCTTCCTCGGCTGCTGGGTTTGCTGCGTTG ATCACAGCCATCGCCAAGTTGTACGAATTGCCCAAGACATGTCGGAGTTGTCCAAGATTGC TCGTAAAGGTTCTGGTTCTGCCGTGCAGATCCCTCTTTGGCGGGTTTGTTGCGTGGGAGATGG GCGACGCCGCCGACGGACAAGACTCCAAGGCAGTTGAAGTTGCGCCTTTGGACCACTGGCC TAGCATGAGGGCGGTTATTTTGGTGGTCAGCGACGACAAAAAGGACACCCCAAGCACCACC GGTATGCAAGCCACCGTGCAAACCTCCGACTTGTTTGCCCACCGCGTCACCAAAGTCGTCC CCCAGTGTTTCGAAGAGATGAAGAAGGCCATCGTCGCCAAGGACTTTCCTAAATTTACCGAG TTAACCATGAAGGATTCCAACTCGTTCCACGCTGTTTGTTTGGACTCGTACCCTCCAATCTTC TACCTCAACGACACCTCCAAGAAGATCATCAAGTTGGTGGAGGCCATCAACAAGCACGCCAC CATCGCTGCCTACACGTTCGACGCGGGCCCCAACGCCGTCATCTACTACGACGCCGCTAAC GAAGACGAGGTCTTGTCCCAGCTCTACAAGTCGTTTGGCCACGTTCAAGGATGGAAGAAAGC CTACACCGCGGAAACAGCCGTTGCCGGTGTTTCACGTATTATTCAAACATCTATTGGTCAAG GACCGCAAGTTACAAACGAATCATTAATCAACGAAAGTGGGTTACCAAACTAA | 376 |
| IDI1 | Candida viswanathii | ATGTCATCAGAATACGCTAAACTAGTGGCAAGTTTCTCCCCAAACGACATATTGGCTAAATGG CCAGAGGTCACTCCATTGAAGAAGATATCAGGCATCCCAAGATCAGCCGAGTCAGACAGCTC CAACGGCTCCCACAACAACACAGAACTTTTCAATGGCCACGACGAGGAGCAAATCAGATTGA TGGAGGAGCTTTGCATTGTTTTGGACTACGACGACAAGCCTGTTGGGGCAGGAACAAAGAA GTTGTGTCATATCATGGACAATATCAACGAAGGATTGTTGCACCGTGCCTTCTCGGTGTTTTT ATTCAATGAGGACGGGAAATTATTATTACAACAACGTGCCGATGAAAAAATCACCTTCCCTGC CATGTGGACAAATACTTGCTGTTCCCATCCTTTGTGTTCCTAGTGAGTTGGGGGTTGATGC CGATGCCAAAGATGTCAACAACTTGGATAACGCCGTGCATGGAGCCAAGGTGGCCGCACAA AGAAAATTGGACCATGAGTTGGGCATCCCATTCAGTGACACTCCCTTGGACCAGTTCACGTA CTTGACTAGAATTCACTATAAATCAGCCAGTGGTGCAGAAGACTCCAAATGGGGTGAGCATG AAATAGACTATATTTTGATATTGAAGACCAACAGACATCAACATCAATGCCAACTATAATGA AGTCAAGGATTATAAGTATGTGGACGCCAAGGAGTTGCAGGAGATGTTTGAAGATAAGGACT TGGTGTTCACCCCGTGGTTTAAATTGATCTGTCAATCTTTCTTATTCAAATGGTGGAATAATTT AAGTGATTTAGAAAAGTACCAAGATACTGAGATACATAGATTACTTTAA | 377 |
| ERG20 | Candida viswanathii | ATGTCTGATAAAGCAGCCGCTAGAGAGAGATTCCTCTCTGTTTTTGAGTGTGCCGTCGAGGA ATTGAAAGAAGTCTTGGTTTCTCACAAGATGCCGCAAGAAGCAATTGACTGGTTTGTCAAGAA CTTGAACTACAACACCCCCGGCGGTAAGTTGAACAGAGGTTTGTCTGTTGTCGACACCTACG CTATCTTGAACAACACCACCGCTGACAAGTTGAACGATGAACAATACAAGAAGGTCGCCTTG TTGGGCTGGTCAATTGAATTGTTGCAAGCTTACTTTTGGTTGCCGATGATATGATGGACCAA TCCAAGACCAGAAGAGGACAGAAATGTTGGTACTTGGTCGAAGGTGTTGAAACATTGCAAT TAATGACTCCTTCATGTTGGAAGGTGCCATTTACGTCTTGTTGAAGAAGCACTTCCGTCAAGA TCCATACATGTCGACTTGTTGGACTTGTTCCACGAAGTCACCTTCCAGACCGAATTGGGTCA ATTATTGGACTTGGTGACTGCTGATGAAGAAGTCGTCGACTTGGACAAGTTCTCTTGGACA AGCACTCGTTCATTGTCATTTTCAAAACCGCATACTACTCCTTACTTGCCTGTTGCTTTGGC CATGTACATGAGCGGTATCAGCAGCGAAGAAGACTTGAAGCAAGTCAGAGATATCTTGATCC CATTGGGTGAGTACTTCCAAATCCAGGACGATTTCTTGGACTGTTTCGGAACCCCAGAACAA ATTGGCAAGATCGGTACTGATATCAAAGACAACAAGTGTTCCTGGGTGGTCAACCAAGCTTT GTTGCATGCTACTCCAGAACAACGTAAGTTGTTGGACGACAACTACGGTAAGAAAGACGACG AGTCTGAACAGAGATGCAAGGACTTGTTCAAGTCCATGGGCATTGAAAAGATCTACCACGAC TACGAAGAGTCAATTGTTGCTAAATTAAGAGAACAAATCGATAAAGTTGATGAATCAAGAGGT TTGAAAAAAGATGTCTTGACCGCTTTCTTGGGCAAGGTTTACAAGAGATCCAAATAG | 378 |

TABLE 25-continued

| Gene | Organism | Native Cv sequence | SEQ ID NO |
|---|---|---|---|
| BTS1 | Candida viswanathii | ATGTCATTCAACATCGATAGCTTAATCCAACCAGGCGCCGCCTACGACCCATCTATGACCGA<br>CGCCATCATGAAGCCATACAGGTACATCTCCGAGGTCCCCAGCAACAACCACAACGTGCGTA<br>CGCGCTTCTTGCTTGCATTCAACGAGTTGTTCTACGGCATGAAGAACGAGGACTTGCTCCAC<br>CGCATCAGCCACATCATCTCCGTGTTCCACAACTCGTCCTTGTTGATCGACGACATCGAGGA<br>CGACTCGCAGTTGCGCCGCGGCATGCCGGTGGCACACGTCAAGTACGGCGTCCCGTTGAC<br>CATCAACTGCGGCAACATGATGTACTTCGTCGCGGTCCAGAAAGCGATTGACTTGGCGGGC<br>GAGGGCTGGGTCCGCGGAGTTGAAGTTCGAGACGTCGCAGATCTTGGTTGACGAAATGATGA<br>ATGTTCACCATGGACAAGGCTTGGATATTTACTGGAGAGACTACTTGAAGGACCTCGAGCAC<br>TTGCCTGAGATCGAGGATTACTTGGGCATGGTCAAGGACAAGACTGGGAGCTTGTTCAGATT<br>GGCCATCAAATTGTTGCTGTTGCATTCGGACGTGGGCGAGGACAATGGTTTGGTCGCGATTG<br>CCAACTTGTTGGGCATAATCTACCAAATCAGAGACGACTACTTGAACTTGGTCGATATCAAGT<br>ACTCCGCCATGAAGGGCGTTACTTGTGAAGACTTGATTGAAGGTAAGTTATCCTTGCCTATTT<br>TGCATTGCTTGAGAACCACGACTAATTCCCCGGTTCACGAGATCCTATACAACTACAACACCA<br>GCGCTGAGCGCGCCAAACAGAACGCCTTGATTGAAGAGTGCTTGACTTACATGAAGAACAAG<br>TCGAGATCCTTGCAATATACTTTGGACTTGATCAAGACCTTGGAGCGCAAGATCAAGGCTAT<br>GATGACCAAGTATCCAAACCTGGAGAACTCCGGCTTGATAAAAATCATTGACAGGTTGTGTG<br>ATCTT | 379 |
| CRC1 | Candida viswanathii | ATGGACGACGTTGATTCTGCTTTAGCCGATAATGTTAAATCCTTCGCTGCCGGTGGTTTTGGT<br>GGTATTTGTGCCGTGTTGACCGGTCATCCATTCGACTTGGTCAAGGTCAGATTGCAAACTGG<br>GTTGTACAAATCGTCAGTGCAATGTGTCAAAGAAACAATAGCCAAAGACGGGTTGTTGGGT<br>TATACAGAGGTGTCTTGCCTCCATTGTTGGGTGTCACCCCAATGTTTGCTGTTTCCTTCTGGG<br>GTTACGACGTTGGTAAGAAATTGGTTTCTTCCTTCACTGGCAAATCAGTCGACAAGTTTGAAA<br>TCAAAGACATTTCGACTGCCGGTTTCATCAGTGCCATCCCAACCACCTTGGTTGCCGCTCCA<br>TTCGAAAGAGTCAAGGTCATGATGCAGATCCAAGAAGGTGCCAAGTCCAAGTCCATGGGTGC<br>CGTTGTTGCTGAAATGTACAGAACCGGTGGTATCAGATCCATCTTCAAGGGTACTGTGGCTA<br>CTTTGGCCAGAGATGGTCCAGGTTCTGCCTTGTATTTCGCTACTTATGAATGGGTCAAGAAG<br>GAATTGACTGCCCCTGGTGAAGACTTGTCCTTGTTTGCTATTACCACTGCTGGTGGTTTCGCT<br>GGTATTGCCATGTGGTTGGGTGTTTTCCCAATTGACACCATCAAGTCTACCCAGCAGTCTTCC<br>AACGTCAAGGTCTCCATTGTGCAGGCCACTAAGAACATCTACGCTAAAGGTGGTATCAAGGC<br>TTTCTTCCCTGGTGTTGGTCCTGCCTTGGCCAGAGCTTTCCCAGCCAACGCTGCTACCTTCC<br>TAGGGGTTGAATTGGCCAGAAAGTTCTTGGACAAAGTTATATAA | 380 |
| FAA1 | Candida viswanathii | ATGGGTGCCCCTTTAACAGTCGCCGTTGGCGAAGCAAAACCAGGCGAAACCGCTCCAAGAA<br>GAAAAGCCGCTCAAAAAATGGCCTCTGTCGAACGCCCAACAGACTCAAAGGCAACCACTTTG<br>CCAGACTTCATTGAAGAGTGTTTTGCCAGAAACGGCACCAGAGATGCCATGGCCTGGAGAG<br>ACTTGGTCGAAATCCACGTCGAAACCCAAACAGGTTACCAAAATCATTGACGGCGAACAGAAA<br>AAGGTCGATAAGGACTGGATCTACTACGAAATGGGTCCTTACAACTACATATCCTACCCCAA<br>GTTGTTGACGTTGGTCAAGAACTACTCCAAGGGGTTTGTTGGAGTTGGGCTTGGCCCCAGATC<br>AAGAATCCAAGTTGATGATCTTTGCCAGTACCTCCCACAAGTGGATGCAGACCTTCTTAGCCT<br>CCAGTTTCCAAGGTATCCCCGTTGTCACCGCCTACGACACCTTGGGTGAGTCGGGCTTGAC<br>CCACTCCTTGGTGCAAACCGAATCCGATGCCGTGTTCACCGACAACCAATTGTTGTCCTCCT<br>TGATTCGTCCTTTTGGAGAAGGCCACCTCCGTCAAGTATGTCATCCACGGGGAAAAGATTGAC<br>CCTAACGACAAGAGACAGGGCGGCAAAATCTACCAGGATGCCGGAAAAAGGCCAAGGAGAAGA<br>TTTTACAAATTAGACCAGATATTAAATTTATTTCTTTCGACGAGGTTGTTGCATTGGGTGAACA<br>ATCGTCCAAAGAATTGCATTTCCCAAAACCAGAAGACCCAATCTGTATCATGTACACCTCGGG<br>TTCCACCGGTGCTCCAAAGGGTGTGGTTATCACCAATGCCAACATTGTTGCCGCCGTGGGTG<br>GTATCTCCACCAATGCTACTAGAGACTTGGTTAGAACTGTCGACAGAGTGATTGCATTTTTGC<br>CATTGGCCCACATTTTCGAGTTGGCCTTTGAGTTGGTTACCTTCTGGTGGGGGGCTCCATTG<br>GGTTACGCCAATGTCAAGACTTTGACCGAAGCCTCCTGCAGAAACTGTCAGCCAGACTTGAT<br>TGAATTCAAACCAACCATCATGGTTGGTGTTGCTGCCGTTTGGGAATCGGTCAGAAAGGGTG<br>TCTTGTCTAAATTGAAACAGGCTTCTCCAATCCAACAAAAGATCTTCTGGGCTGCATTCAATG<br>CCAAGTCTACTTTGAACCGTTATGGCTTGCCAGGCGGTGGGTTGTTTGACGCTGTCTTCAAG<br>AAGGTTAAAGCCGCCACTGGTGGCCAATTGCGTTATGTGTTGAATGGTGGGTCCCCAATCTC<br>TGTTGATGCCCAAGTGTTTATCTCCACCTTGCTTGCGCCAATGTTGTTGGGTTACGGTTTGAC<br>TGAAACCTGTGCCAATACCACCATTGTCGAACACACGCGCTTCCAGATTGGTACTTTGGGTA<br>CCTTGGTTGGATCTGTCACTGCCAAGTTGGTTGATGTTGCTGATGCTGGATACTACGCCAAG<br>AACAACCAGGGTGAAATCTGGTTGAAAGGCCGGTCCAGTTGTCAAGGAATACTACAAGAACGA<br>AGAAGAAACCAAGGCTGCATTCACCGAAGATGGCTGGTTCAAGACTGGTGATATTGGTGAAT<br>GGACCGCCGACGGTGGTTTGAACATCATTGACCGTAAGAAGAACTTGGTCAAGACTTTGAAT<br>GGTGAATACATTGCTTTGGAGAAATTGGAAAGTATTTACAGATCCAACCACTTGATTTTGAAC<br>TTGTGTGTTTACGCTGACCAAACCAAGGTCAAGCAATTGCTATTGTCTTGCCAATTGAAGCC<br>AACTTGAAGTCTATGTTGAAGGACGAAAAGATTATCCAGATGCTGATTCACAAGAATTGAGC<br>AGCTTGGTTCACAACAAGAAGGTTGCCCAAGCTGTCTTGAGACACTTGCTCCAAACCGGTAA<br>ACAACAAGGTTTGAAAGGTATTGAATTGTTGCAGAATGTTGTCTTGTTGGATGACGAGTGGAC<br>CCCACAGAATGGTTTTGTTACTTCTGCCCAAAAGTTGCAGAGAAAGAAGATTTTAGAAAGTTG<br>TAAAAAAGAAGTTGAAGAGGCATACAAGTCGTCTTAG | 381 |
| FAT1 | Candida viswanathii | ATGTCAGGATTAGAAATAGCCGCTGCTGCCATCCTTGGTAGTCAGTTATTGGAAGCCAAATAT<br>TTAATTGCCGACGACGTGCTGTTAGCCAAGACAGTCGCTGTCAATGCCCTCCCATACTTGTG<br>GAAAGCCAGCAGAGGTAAGGCCATCATACTGGTACTTTTTCGAGCAGTCCGTGTTCAAGAACC<br>CAAACAACAAAGCGTTGGCGTTCCAAGACCAAGAAAGAATGCCCCCACCCCCAAGACCGA<br>CGCCGAGGGATTCCAGATCTACGACGATCAGTTTGACCTAGAAGAATACACCTACAAGGAAT<br>TGTACGACATGGTTTTGAAGTACTCATACATCTTGAAGAACGAGTACGGCGTCACTGCCAAC<br>GACACCATCGGTGTTCTTGTATGAACAAGCCGCTTTTCATTGTCTTGTGGTTGGCATTGTGG<br>AACATTGGTGCCTTGCCTGCGTTCTTGAACTTCAACACCAAGGACAAGCCATTGATCCACTGT | 382 |

TABLE 25-continued

| Gene | Organism | Native Cv sequence | SEQ ID NO |
|---|---|---|---|
| | | CTTAAGATTGTCAACGCTTCGCAAGTTTTCGTTGACCCGGACTGTGATTCCCCAATCAGAGAT ACCGAGGCTCAGATCAGAGAGGAATTGCCACATGTGCAAATAAACTACATTGACGAGTTTGC CTTGTTTGACAGATTGAGACTCAAGTCGACTCCAAAACACAGAGCCGAGGACAAGACCAGAA GACCAACCGATACTGACTCCTCCGCTTGTGCATTGATTTACACCTCGGGTACCACCGGTTTG CCAAAAGCCGGTATCATGTCCTGGAGAAAAGCCTTCATGGCCTCCGGTTTTCTTTGGCCACAT CATGAAGATTGACTCGAAATCGAACGTCTTGACCGCCATGCCCTTGTACCACTCCACCGCGG CCATGTTGGGGTTGTGTCCTACTTTGATTGTCGGTGGCTGTGTCTCCGTGTCCCAGAAATTC TCCGCTACTTCGTTCTGGACCCAGGCCAGATTATGTGGTGCCACCCACGTGCAATACGTCGG TGAGGTCTGTCGTTACTTGTTGAACTCCAAGCCTCATCCAGACCAAGACAGACACAATGTCA GAATTGCCTACGGTAACGGGTTGCGTCCAGATATATGGTCTGAGTTCAAGCGCAGATTCCAC ATTGAAGGTATCGGTGAGTTCTACGCCGCCACCGAGTCCCCTATCGCCACCACCAACTTGCA GTACGGTGAGTACGGTGTCGGCGCCTGTCGTAAGTACGGGTCCCTCATCAGCTTGTTATTGT CTACCCAGCAGAAATTGGCCAAGATGGACCCAGAAGACGAGAGTGAAATCTACAAGGACCC CAAGACCGGGTTCTGTACCGAGGCCGCTTACAACGAGCCAGGTGAGTTGTTGATGAGAATC TTGAACCCTAACGACGTGCAGAAATCCTTCCAGGGTTATTATGGTAACAAGTCCGCCACCAA CAGCAAAATCCTCACCAATGTTTTCAAAAAAGGTGACGCGTGGTACAGATCCGGTGACTTGT TGAAGATGGACGAGGACAAATTGTTGTACTTTGTCGACAGATTAGGTGACACTTTCCGTTGG AAGTCCGAAAACGTCTCCGCCACCGAGGTCGAGAACGAATTGATGGGCTCCAAGGCCTTGA AGCAGTCCGTCGTTGTCGGTGTCAAGGTGCCAAACCACGAAGGTAGAGCCTGTTTTGCCGT CTGTGAAGCCAAGGACGAGTTGAGCCATGAAGAAATCTTGAAATTGATTCACTCTCACGTGA CCAAGTCTTTGCCTGTGTATGCTCAACCTGCGTTCATCAAGATTGGCACCATTGAGGCTTCG CACAACCACAAGGTTCCTAAGAACCAATTCAAGAACCAAAAGTTGCCAAAGGGTGAAGACGG CAAGGATTTGATCTACTGGTTGAATGGCGACAAGTACCAGGAGTTGACTGAAGACGATTGGT CTTTGATTTGTACCGGTAAAGCCAAATTGTAG | |
| tHMG1 | Candida viswanathii | ATGGACCAAGAAATGTCTCGTCCAAAACAAGCCGCTGCTGCTGCTGTTGCTCCATCTGCCGC AAAATCAGTGGCGCCAGAAGAAGACGAAGACGAAACCTCCAGCGAGGAACTTGAAATCAAA GCTCCTGTCAAGCCATTACCACTTGAAGAATGTACCAGAATCCTCAAAGAGGGCAAAGTCAA GACCTTGTCCAATGCTGAAGTGTCTAGTTTGGTTGTTGGTGGTAAATTGCCATTGTACGCTTT GGAGAAGCAATTGGGCGACCACAAGAGAGCCGTGGCTGTTCGTCGTAAGGCTATTGCAAAA TTAGCTAATGCGCCAGTATTAGAAACCAACCGTTTACCTTACTCCCACTATGATTATGATAGA GTTTTTGGTGCTTGTTGTGAGAATGTTATTGGATACATGCCAATCCCTGTTGGTGTTGCTGGA CCATTAGTTATTGATGGCAAGCCATACCACATCCCCATGGCCACTACTGAAGGTTGTCTTGTT GCCTCTACTATGCGTGGTTGTAAAGCTATTAACGCTGGAGGTGGTGTTGAAACTGTCTTGAC CAAAGATGGTATGACTAGAGGTCCTTGTGTTCGTTTCCCAACTTTGAAAAGAGCCGGCGCTG CAAAGTTGTGGATTGACTCCGAAGAAGGTCAAATCACCATCAAAAAGGCATTCAACTCGACTT CTAGATTTGCTCGTTTGCAACATATTCAAACTGCCCTCGCTGGTACCTCGTTGTTTATTAGATT TAGAACTACTACTGGTGATGCCATGGGTATGAACATGATTTCCAAAGGTGTTGAGTATTCCTT GAAGTACATGGTTGAAGAATGTGGCTGGGACGATATGGAAGTTATCTCTGTTTCTGGTAACTA CTGTACCGATAAGAAACCAGCTGCTATTAACTGGATCGAAGGTAGAGGTAAGTCTATTGTTG CCGCTGCTACCATTCCTGCTGATGTTGTCACTAAAGTCTTGAAATCCGATGTCGATGCATTAG TTGAATTGAATGTTTCTAAGAACTTGGTTGGTTCAGCCATGGCCGGTTCAGTTGGTGGTTTCA ACGCCCATGCAGCCAACTTGGTCACAGCTGTTTTATTTGGCCTGTGGTCAGGACCCTGCACAA AACGTCGAATCTTCAAACTGTATTACTTTGATGAAAAGGACAAACAGACTGGTGACTTGGTG ATTTCTGTTTCTATGCCATCATCGAAGTTGGTACGATTGGTGGTGGTACCATTTTGGAACCA CAAGCAGCCATGTTGGACTTGTTGGGCGTGCGTGGTCCTCACCCAACCAACCCTGGTGACA ATGCAAGACAATTGGCCAAGATTGTTGCTTGGCAGTGTTAGCAGCTGAATTGTCACTTTGTT CCGCTTTGGCTGCTGGTCACTTGGTGCAATCCCACATGCAACACAACCGTAAGGAGCTACC GCCGCCGCCGCCGCAGCAGCCCCTGCAATCGCCAACGGCCGTGCCAATGGAACCAAA ACCAATGGGTCTATCAATGGGAAAGACTTGAAGCGTCTCAAAGACGGATCAGTTACATGTAT AAAGTCA | 383 |
| POX4 | Candida viswanathii | ATGACTTTTACAAAGAAAAACGTTAGTGTATCACAAGGTCCTGACCCTAGATCATCCATCCAA AAGGAAAGAGACAGCTCCAAATGGAACCCTCAACAAATGAACTACTTCTTGGAAGGCTCCGT CGAAAAGAAGTGAGTTGATGAAGGCTTTGGCCCAACAAATGGAAAGAGACCCAATCTTGTTCA CAGACGGCTCCTACTACGACTTGACCAAGGACCAACAAAGAGAATTGACCGCCGTCAAGATC AACAGAATCGCCAGATACAGAGAACAAGAATCCATCGACACTTTCAACAAGAGATTGTCCTTG ATTGGTATCTTTGACCCACAGGTCGGTACCAGAATTGGTGTCAACCTCGGTTTGTTCCTTTCT TGTATCAGAGGTAACGGTACCACTTCCCAATTGAACTACTGGGCTAACGAAAAGGAAACCGC TGACGTTAAAGGTATCTACGGTTGTTTCGGTATGACCGAATTGGCCCACGGTTCCAACGTTG CTGGTTTGGAAACCACCGCCACATTTGACAAGGAATCTGACGAGTTTGTCATCAACACCCCA CACATTGGTGCCACCAAGTGGTGGATTGGTGGTGCTGCTCACTCCGCCACCCACTGTTCTGT CTACGCCAGATTGATTGTTGACGGTCAAGATTACGGTGTCAAGACTTTTGTTGTCCCATTGAG AGACTCCAACCACGACCTCATGCCAGGTGTCACTGTTGGTGACATTGGTGCCAAGATGGGTA GAGATGGTATCGATAACGGTTGGATCCAATTCTCCAACGTCAGAATCCCAAGATTCTTTATGT TGCAAAAGTTCTGTAAGGTTTCTGCTGAAGGTGAAGTCACCTTGCCACCTTTGGAACAATTGT CTTACTCCGCCTTGTTGGGTGGTAGAGTCATGATGGTTTTGGACTCCTACAGAATGTTGGCT AGAATGTCCACCATTGCCTTGAGATACGCCATTGGTAGAAGACAATTCAAGGGTGACAATGT CGATCCAAAAGATCCAAACGCTTTGGAAACCCAATTGATAGATTACCCATTGCACCAAAAGAG ATTGTTCCCATACTTGGCTGCTGCCTACGTCATCTCCGCTGGTGCCCTCAAGGTTGAAGACA CCATCCATAACACCTTGGCTGAATTGGACGCTGCCGTTGAAAAGAACGACACCAAGGCTATC TTTAAGTCTATTGACGACATGAAGTCATTGTTTGTTGACTCTGGTTCCTTGAAGTCCACTGCC ACTTGGTTGGGTGCTGAAGCCATTGACCAATGTAGACAAGCCTGTGGTGGTCACGGTTACTC GTCCTACAACGGCTTCGGTAAAGCCTACAACGATTGGGTTGTCCAATGTACTTGGGAAGGTG ACAACAATGTCTTGGCCATGAGTGTTGGTAAGCCAATTGTCAAGCAAGTTATCAGCATTGAAG ATGCCGGCAAGACCGTCAGAGGTTCCACCGCTTTCTTGAACCAATTGAAGGACTACACTGGT TCCAACAGCTCCAAGGTTGTTTTGAACACTGTTGCTGACTTGGACGACATCAAGACTGTCATC | 384 |

TABLE 25-continued

| Gene | Organism | Native Cv sequence | SEQ ID NO |
|---|---|---|---|
| | | AAGGCTATTGAAGTTGCCATCATCAGATTGTCCCAAGAAGCTGCTTCTATTGTCAAGAAGGAA<br>TCTTTCGACTATGTCGGCGCTGAATTGGTTCAACTCTCCAAGTTGAAGGCTCACCACTACTTG<br>TTGACTGAATACATCAGAAGAATTGACACCTTTGACCAAAAGGACTTGGTTCCATACTTGATC<br>ACCCTCGGTAAGTTGTACGCTGCCACTATTGTCTTGGACAGATTTGCCGGTGTCTTCTTGACT<br>TTCAACGTTGCCTCCACCGAAGCCATCACTGCTTTGGCCTCTGTGCAAATTCCAAAGTTGTGT<br>GCTGAAGTCAGACCAAACGTTGTTGCTTACACCGACTCCTTCCAACAATCCGACATGATTGTC<br>AATTCTGCTATTGGTAGATACGATGGTGACATCTATGAGAACTACTTTGACTTGGTCAAGTTG<br>CAGAACCCACCATCAAGACCAAGGCTCCTTACTCTGATGCTTTGGAAGCCATGTTGAACAG<br>ACCAACCTTGGACGAAAGAGAAAGATTTGAAAGTCTGATGAAACCGCTGCTATCTTGTCCAA<br>GTAA | |
| POX5 | Candida viswanathii | ATGCCTACCGAACTTCAAAAAGAAAGAGAACTCACCAAGTTCAACCCAAAGGAGTTGAACTA<br>CTTCTTGGAAGGTTCCCAAGAAAGATCCGAGATCATCAGCAACATGGTCGAACAAATGCAAA<br>AAGACCCTATCTTGAAGGTCGACGCTTCATACTACAACTTGACCAAAGACCAACAAAGAGAA<br>GTCACCGCCAAGAAGATTGCCAGACTCTCCAGATACTTTGAGCACGAGTACCCAGACCAACA<br>GGCCCAGAGATTGTCGATCCTCGGTGTCTTTGACCCACAAGTCTTCACCAGAATCGGTGTCA<br>ACTTGGGTTTGTTTGTTTCCTGTGTCCGTGGTAACGGTACCAACTCCCAGTTCTTCTACTGGA<br>CCATAAATAAGGGTATCGACAAGTTGAGAGGTATCTATGGTTGTTTTGGTATGACTGAGTTGG<br>CCCCACGGTTCCAACGTCCAAGGTATTGAAACCACCGCCACTTTTGACGAAGACACTGACGAG<br>TTTGTCATCAACACCCCACACATTGGTGCCACCAAGTGGTGGATCGGTGGTGCTGCGCACTC<br>CGCCACCCACTGCTCCGTCTACGCCAGATTGAAGGTCAAAGGAAAGGACTACGGTGTCAAG<br>ACCTTTGTTGTCCCATTGAGAGACTCCAACCACGACCTCGAGCCAGGTGTGACTGTTGGTGA<br>CATTGGTGCCAAGATGGGTAGAGACGGTATCGATAACGGTTGGATCCAGTTCTCCAACGTCA<br>GAATCCCAAGATTCTTTATGTTGCAAAGTACTGTAAGGTTTCCCGTCTGGGTGAAGTCACCA<br>TGCCACCATCTGAACAATTGTCTTACTCGGCTTTGATTGGTGGTAGAGTCACCATGATGATGG<br>ACTCCTACAGAATGACCAGTAGATTCATCACCATTGCCTTGAGATACGCCATCCACAGAAGA<br>CAATTCAAGAAGAAGGACACCGATACCATTGAAACCAAGTTGATTGACTACCCATTGCATCAA<br>AAGAGATTGTTCCCATTCTTGGCTGCCGCTTACTTGTTCTCCAAGGTGCCTTGTACTTAGAA<br>CAAACCATGAACGCAACCAACGACAAGTTGGACGAAGCTGTCAGTGCTGGTGAAAAGGAAG<br>CCATTGACGCTGCCATTGTCGAATCCAAGAAATTGTTCGTCGCTTCCGGTTGTTTGAAGTCCA<br>CCTGTACCTGGTTGACTGCTGAAGCCATTGACGAAGCTCGTCAAGCTTGTGGTGGTCACGGT<br>TACTCGTCTTACAACGGTTTCGGTAAAGCCTACTCCGACTGGGTTGTCCAATGTACCTGGGA<br>AGGTGACAACAACATCTTGGCCATGAACGTTGCCAAGCCAATGGTTAGAGACTTGTTGAAGG<br>AGCCAGAACAAAAGGGATTGGTTCTCTCCAGCGTTGCCGACTTGGACGACCCAGCCAAGTT<br>GGTTAAGGCTTTCGACCACGCCCCTTTCCGGCTTGGCCAGAGACATTGGTGCTGTTGCTGAAG<br>ACAAGGGTTTCGACATTACCGGTCCAAGTTTGGTTTTGGTTTCCAAGTTGAACGCTCACAGAT<br>TCTTGATTGACGGTTTCTTCAAGCGTATCACCCCAGAATGGTCTGAAGTCTTGAGACCTTTGG<br>GTTTCTTGTATGCCGACTGGATCTTGACCAACTTTGGTGCCACCTTCTTGCAGTACGGTATCA<br>TTACCCCAGATGTCAGCAGAAAGATTTCCTCCGAGACATTCCCAGCCTTGTGTGCCAAGGTT<br>AGACCAAACGTTGTTGGTTTGACTGATGGTTTCAACTTGACTGACATGATGACCAATGCTGCT<br>ATTGGTAGATATGATGGTAACGTCTACGAACACTACTTCGAAACTGTCAAGGCTTTGAACCCA<br>CCAGAAAACACCAAGGCTCCATACTCCAAGGCTTTGGAAGACATGTTGAACCGTCCAGACCT<br>TGAAGTCAGAGAAAGAGGTGAAAAGTCCGAAGAAGCTGCTGAAATCTTGTCCAGTTAA | 385 |
| URA3 | Candida viswanathii | ATGGTTAGCACAAAACATACACAGAAAGGGCATCAGCACACCCCTCCAAGGTTGCCCAACG<br>TTTATTCCGCTTAATGGAGTCCAAAAAGACCAACCTCTGCGCCTCGATCGACGTGACCACAA<br>CCGCCGAGTTCCTTTCGCTCATCGACAAGCTCGGTCCCCACATCTGTCTCGTGAAGACGCAC<br>ATCGATATCATCTCAGACTTCGACTACGAGGGCACGATTGAGCCGTTGCTTGTCGTTGCAGA<br>GCGCCACGGGTTCTTGATATTCGAGGACAGGAAGTTTGCTGATATCGGAAACACCGTGATGT<br>TGCAGTACACCTCGGGGGTATACCGGATCGCGGCGTGGAGTGACATCACGAACGCGCACG<br>GAGTGACTGGGAAGGGCGTCGTTAAGGGTTGAAACGCGGTGCGGAGGGGGTAGAAAAGG<br>AAAGGGGCGTGTTGATGTTGGCGGAGTTGTCGAGTAAAGGCTCGTTGGCGCATGGTGAATA<br>TACCCGTGAGACGATCGAGATTGCGAAGAGTGATCGGGAGTTCGTGATTGGGTTCATCGCG<br>CAGCGGGACATGGGGGGTAGAGAAGAAGGGTTTGATTGGATCATCATGACGCTGGTGTGG<br>GGTTGGATGATAAAGGCGATGCGTTGGGCCAGCAGTATAGGACTGTTGATGAGGTGGTTCT<br>GACTGGGTACCGATGTGATTATTGTCGGGAGAGGGTTGTTTGGAAAAGGAAGAGACCCTGAG<br>GTGGAGGGAAAGAGATACAGGGATGCTGGATGGAAGGCATACTTGAAGAGAACTGGTCAGT<br>TAGAATAA | 386 |
| LEU2 | Candida viswanathii | ATGTCCGTTAAAAACCAAAACCATCACTATTCTCCCAGGTGACCACGTCGGTACCGAGATCGT<br>TGCCGAGGCAATCAAGTCCTTACATGCCATTGAGTCCCTGACCCCATACCAAAAAGTTCATTT<br>TGAGTTCAAGCACCACTTGATAGGCGGTGCCGCCATTGACGCCACTGGTGTGCCGCTCCCA<br>GACGACGCCTTAGCCGCCGCCAAGTCCTCAGACGCCGTGTTGCTCGGGGCCGTCGGTGGA<br>CCCAAATGGGGAACCGGCGCTGTGCGTCCAGACAGGGATTGTTGAAGATCCGTAAGGAGT<br>TGAACCTTTATGCCAACATCAGACCATGCAATTTCGCTAGCGACTCCTTGCTTGAGCTCTCTC<br>CGTTACGTCCTGAGGTCGTCAAGGGCACCAACTTGATCATTGTGCGTGAGCTAGTTGGTGG<br>GATTTACTTTGGTGAGAGACAGGAGCAGGAAGAAAGCGAGGATGGGAAATCGGCTTGGGAT<br>ACTGAAAAGTACACCGTTGATGAAGTCGCGAGAATTACACGCATGGCTGCGTTCATGGCATT<br>GCAACACACCCCACCATTGCCAATCTGGTCTTGGACAAAGCCAACGTGCTTGCCTCGTCAA<br>GATTGTGGAGAAAGACAGTGGATAAAATCATCAGTGAAGAGTTCCCTACCTTGGCTGTCCAG<br>CACCAGTTGATTGACTCCGCGGCTATGATCTTGATCCAGAACCCAACGAAGTTGAACGGGAT<br>CATCATCACGTCGAACATGTTTGGTGATATCATATCCGATGAAGCGTCCGTGATCCCAGGGT<br>CCTTGGGATTGTTGCCATCTGCGTCATTGGCTTCGTTACCGGACACAAACACTGCGTTTGGT<br>CTCCTATGAGCCATGCCATGGTTCGGCACCTGATTTGCCAGAGAACAAAGTCAACCCTATTGC<br>GACAATCTTGTCCGTTGCTAGTATGTTGAGATTGAGTTTGGATTGTGTTAAGGAAGCCGAGG | 387 |

TABLE 25-continued

| Gene | Organism | Native Cv sequence | SEQ ID NO |
|------|----------|--------------------|-----------|
|      |          | CTTTGGAACAGGCCGTGAAGGAAGTCTTGGATAAGGGGATCAGAACGGCGGATTTGAGAGG TAGTAGCACAACCACTGAAGTCGGTGATGCCGTTGCTGAAACCGTCTCCAGAATCTTGAAAG AAGCTAAGGCTTGA | |

Example 71: Plasmids

Certain plasmids described herein are further characterized in Table 26 below.

TABLE 26

| Plasmid No. | Description |
|-------------|-------------|
| pAA1116 | POX4 promoter + POX5F98G + POX4 terminator in AFC |
| pAA1164 | HDE1 promoter + POX5F98G + POX4 terminator in AFC |
| pAA1701 | CRC1 knockout cassette 1 |
| pAA2214 | G6PI promoter + CRC1 + terminator POX4 @ int5 Integration site |
| pAA2311 | G6PI promoter + CRC1 + terminator POX4 in AFC |
| pAA2534 | GPD promoter + Caenorhabditis elegans FAT5 CvCO + POX4 terminator in AFC |
| pAA2698 | GPD promoter + CsCrtE CvCO + POX4 terminator in AFC |
| pAA2699 | GPD promoter + CsCrtB CvCO + POX4 terminator in AFC |
| pAA2700 | GPD promoter + CsCrtI CvCO + POX4 terminator in AFC |
| pAA2701 | GPD promoter + CnTPS1 CvCO + POX4 terminator in AFC |
| pAA2702 | HDE1 promoter + CsCrtE CvCO + POX4 terminator in AFC |
| pAA2703 | HDE1 promoter + CsCrtB CvCO + POX4 terminator in AFC |
| pAA2704 | HDE1 promoter + CsCrtI CvCO + POX4 terminator in AFC |
| pAA2705 | HDE1 promoter + CnTPS1 CvCO + POX4 terminator in AFC |
| pAA2866 | GPD promoter + XdCrtYB CvCO + POX4 terminator in AFC |
| pAA2993 | GPD promoter + XdCrtR CvCO + POX4 terminator in AFC |
| pAA2994 | GPD promoter + XdCrtS CvCO + POX4 terminator in AFC |
| pAA2995 | GPD promoter + AaCrtW CvCO + POX4 terminator in AFC |
| pAA2996 | GPD promoter + AaCrtZ CvCO + POX4 terminator in AFC |
| pAA2998 | Plasmid from Invitrogen containing XdCrtR CvCO |
| pAA2999 | Plasmid from Invitrogen containing XdCrtS CvCO |
| pAA3000 | Plasmid from Invitrogen containing AaCrtW CvCO |
| pAA3001 | Plasmid from Invitrogen containing AaCrtZ CvCO |
| pAA3373 | HDE1 promoter + XdCrtYB CvCO + POX4 terminator in AFC |
| pAA3189 | GPD promoter + XdCrtE + POX4 terminator in AFC |
| pAA3190 | GPD promoter + PaCrtE + POX4 terminator in AFC |
| pAA3378 | GPD promoter + PaCrtB + POX4 terminator in AFC |
| pAA3490 | GPD promoter + XdCrtI + POX4 terminator in AFC |
| pAA3633 | HDE promoter + XdCrtE CvCO + POX4 terminator in AFC |
| pAA3634 | HDE promoter + XdCrtI CvCO + POX4 terminator in AFC |
| pAA408 | Contains URA3 terminator + URA3 promoter + URA3 + URA3 terminator |
| pAA3060 | LEU2 knock-out cassette 1 |
| pAA2417 | LEU2 knock-out cassette 2 |
| pVZ3930 | RAS2 knock-out cassette |
| pVZ4045 | LEU2 single crossover AFC |
| pVZ4056 | HDE promoter + XdCrtE CvCO + POX4 terminator in AFC, leucine |
| pVZ4057 | HDE promoter + CsCrtB CvCO + POX4 terminator in AFC, leucine |
| pVZ4058 | HDE promoter + XdCrtI CvCO + POX4 terminator in AFC, leucine |
| pVZ4083 | Ppox18 -Tpox18 in AFC, leucine |
| pVZ4098 | POX18 promoter + Erg10 + POX18 terminator in AFC, leucine |
| pVZ4099 | POX18 promoter + Erg13 + POX18 terminator in AFC, leucine |
| pVZ4100 | POX18 promoter + HMG1 + POX18 terminator in AFC, leucine |
| pVZ4101 | POX18 promoter + Erg12 + POX18 terminator in AFC, leucine |
| pVZ4122 | POX18 promoter + Erg8 + POX18 terminator in AFC, leucine |
| pVZ4123 | POX18 promoter + Mvd1 + POX18 terminator in AFC, leucine |
| pVZ4104 | POX18 promoter + Idi1 + POX18 terminator in AFC, leucine |
| pVZ4105 | POX18 promoter + Erg20 + POX18 terminator in AFC, leucine |

AFC = antibiotic free cassette, uracil marker unless indicated otherwise
CvCO = Codon optimized for Candida viswanathii

Example 72: Oligonucleotides

Certain oligonucleotides described herein are provided in Table 27 below.

TABLE 27

| Oligo No. | Sequence | SEQ ID NO |
|-----------|----------|-----------|
| oAA02206 | TTCCGCTTAATGGAGTCCAAA | 388 |
| oAA2091 | GCATACAACGGAAATTTGCTTT | 389 |

TABLE 27-continued

| Oligo No. | Sequence | SEQ ID NO |
|---|---|---|
| oAA02209 | TAAACGTTGGGCAACCTTGG | 390 |
| oAA5511 | ATGGACGACGTTGATTCTGCTTTAGCCGATAATGTT | 391 |
| oAA5512 | TTATATAACTTTGTCCAAGAACTTTCTGGCC | 392 |
| oAA05788 | GAATAGAAGAGAGTGACTCTTTTG | 393 |
| oAA05789 | GATTGATTGTTATAGTTTCTTTCTTTC | 394 |
| oAA07265 | CTGCAGGCATGATGATCTG | 395 |
| oAA07511 | ATCGATTAAATTCTTTAATTGAGGG | 396 |
| oAA07512 | GAATAGAAGAGAGTGACTCTTTTG | 397 |
| oAA07624 | AGATCATCATGCCTGCAGAAAATCAGAGGCTACTCC | 398 |
| oAA07625 | GTCACTCTCTTCTATTCTTATATAACTTTGTCCAAGAACTTTC | 399 |
| oAA09745 | CCCTCAATTAAAGAATTTAATCGATATGAATGCTAATGCCGTTAAGTC | 400 |
| oAA09746 | TCAAAAGAGTCACTCTCTTCTATTCTTACCCAAACATTGCAAGCTGT | 401 |
| oAA09747 | CCCTCAATTAAAGAATTTAATCGATATGACCAAAACGGTTGTAATAGGATCAGG | 402 |
| oAA09748 | TCAAAAGAGTCACTCTCTTCTATTCTTACGCGTGGCCCTCCAACATT | 403 |
| oAA09749 | CCCTCAATTAAAGAATTTAATCGATATGAGTGACAAGCCTTTGTTAACACATGCTACAGA | 404 |
| oAA09750 | TCAAAAGAGTCACTCTCTTCTATTCTTAAGCGGCAGGAGGGGCGGCA | 405 |
| oAA09751 | CCCTCAATTAAAGAATTTAATCGATATGGCAGAAATGTTCAATGGAAAC | 406 |
| oAA09752 | TCAAAAGAGTCACTCTCTTCTATTCTTAAGGTATAATCGGTTCGACG | 407 |
| oAA09753 | AAGAAAGAAACTATAACAATCAATCATGAATGCTAATGCCGTTAAGTC | 408 |
| oAA09754 | TCAAAAGAGTCACTCTCTTCTATTCTTACCCAAACATTGCAAGCTGT | 409 |
| oAA09755 | AAGAAAGAAACTATAACAATCAATCATGACCAAAACGGTTGTAATAGGATCAGG | 410 |
| oAA09756 | TCAAAAGAGTCACTCTCTTCTATTCTTACGCGTGGCCCTCCAACATT | 411 |
| oAA09757 | AAGAAAGAAACTATAACAATCAATCATGAGTGACAAGCCTTTGTTAACACATGCTACAGA | 412 |
| oAA09758 | TCAAAAGAGTCACTCTCTTCTATTCTTAAGCGGCAGGAGGGGCGGCA | 413 |
| oAA09759 | AAGAAAGAAACTATAACAATCAATCATGGCAGAAATGTTCAATGGAAAC | 414 |
| oAA09760 | TCAAAAGAGTCACTCTCTTCTATTCTTAAGGTATAATCGGTTCGACG | 415 |
| oAA9960 | CCCTCAATTAAAGAATTTAATCGATATGGCAACCCTATCTGACTTGG | 416 |
| oAA9961 | TCAAAAGAGTCACTCTCTTCTATTCTTAGCTCCACACATCCATCAATAATC | 417 |
| oAA9962 | CCCTCAATTAAAGAATTTAATCGATATGTTCATTTTGGTGTTGTTGACC | 418 |
| oAA9963 | TCAAAAGAGTCACTCTCTTCTATTCTTACTCCACTGGCTTTACCTGC | 419 |
| oAA9964 | CCCTCAATTAAAGAATTTAATCGATATGAGTGCCCATGCCTTGCCAA | 420 |
| oAA9965 | TCAAAAGAGTCACTCTCTTCTATTCTTAAGCGGTATCACCTTTAGTTCTAGTGC | 421 |

TABLE 27-continued

| Oligo No. | Sequence | SEQ ID NO |
|---|---|---|
| oAA9966 | CCCTCAATTAAAGAATTTAATCGATATGACAAACTTCTTGATCGTTGTGG | 422 |
| oAA9967 | TCAAAAGAGTCACTCTCTTCTATTCTTACGTCCTCTCTTGGGCCTCA | 423 |
| oAA9968 | GATCCACAAGTTTTCACTAGAATTGG | 424 |
| oAA10284 | CACTGCTTAATTAAGCGCTGTCACTCTTATATCAGTATGACC | 425 |
| oAA10286 | CACTGCGGATCCGGTACCCCACCACGACAACAGGATTCCCC | 426 |
| oAA10287 | CGAGATTTAATTAATTAGCCAACAGGACAATAGAGTTAAAAAGAATGAATTG | 427 |
| oVZ0041 | CGAGATCTGCAGGCGGCCGCTTCTGTGAGTATTTGTTATTGAAAATGAAGGGATGG | 428 |
| oAA7682 | CCACGTCGGTACCGAGATCGTTGCCGAGGCAATCAAGTCCTT | 429 |
| oAA7683 | AACGGCTTCGTCTAAACAACCACGGATCTTCAACAATCCCTGTTCTGGAC | 430 |
| oAA7684 | GTCCAGAACAGGGATTGTTGAAGATCCGTGGTTGTTTAGACGAAGCCGTT | 431 |
| oAA7685 | AGTGTTTGTGTCCGGTAACGACCGAAATATTACAATTGGAGCTCC | 432 |
| oAA7686 | GGAGCTCCAATTGTAATATTTCGGTCGTTACCGGACACAAACACT | 433 |
| oAA7687 | TTTCAGCAACGGCATCACC | 434 |
| oAA7941 | ACCTTTATGCCAACATCAGACC | 435 |
| oAA7942 | AACGGCTTCGTCTAAACAACCCATCAACGGTGTACTTTTCAGTATCC | 436 |
| oAA7943 | GGATACTGAAAAGTACACCGTTGATGGGTTGTTTAGACGAAGCCGTT | 437 |
| oAA7944 | TTGCAATGCCATGAACGCCCGAAATATTACAATTGGAGCTCC | 438 |
| oAA7945 | GGAGCTCCAATTGTAATATTTCGGGCGTTCATGGCATTGCAA | 439 |
| oAA7946 | CAGATGGCAACAATCCCAAG | 440 |
| oVZ337 | AATTAACCTATGGTGCAC | 441 |
| oVZ338 | TTAATTAAAAGCTTGGCGTAATC | 442 |
| oVZ339 | CTCGTGCTAGTCAGTCTTGCACGCTTTGGGTG | 443 |
| oVZ340 | ATGATTACGCCAAGCTTTTAATTAACAACACGGCGTCTGAGGAC | 444 |
| oVZ341 | ACTGAGAGTGCACCATAGGTTAATTAACTCGGGGCCGTCGGTGGA | 445 |
| oVZ342 | AAGCGTGCAAGACTGACTAGCACGAGCGAAGATGGGG | 446 |
| oVZ373 | CTC GGG GCC GTC GGT GGA | 447 |
| oVZ374 | CAACACGGCGTCTGAGGACTTGG | 448 |
| oVZ369 | GCTCAACAATTGTCTGACAAGATCTC | 449 |
| oVZ370 | GAGATTGTTAACTTTATGGGGCAATAAC | 450 |
| oVZ371 | TCCCCATCTTCGCTCGTGCTAGTCAAAGGGAAGAAGAGTCGTTG | 451 |
| oVZ372 | CGTCGGCACCCAAAGCGTGCAAGACGTCGACCTAAATTCGCAAC | 452 |
| oVZ376 | GTGCTAGTCAAGATAAACCGAGGCATGGAAG | 453 |
| oVZ377 | CGTGCAAGACGCATAGACTGCAAGTAAGCAGC | 454 |
| oVZ378 | CAGTCTATGCGTCTTGCACGCTTTGGGTGC | 455 |
| oVZ379 | CGGTTTATCTTGACTAGCACGAGCGAAGATGG | 456 |

TABLE 27-continued

| Oligo No. | Sequence | SEQ ID NO |
|---|---|---|
| oVZ384 | AAAGGAATAAGCTGGGTGTTTGCTCATTTTG | 457 |
| oVZ385 | CGTTAGTCATTTTTGTTAATTGGTGTTTTGTTTAATAATGGGG | 458 |
| oVZ386 | AATTAACAAAAATGACTAACGCACCACAAAACATTG | 459 |
| oVZ387 | AACACCCAGCTTATTCCTTTATAGCATAACTTCTTCTAAACTTGTCG | 460 |
| oVZ388 | AAAGTCATAGGCTGGGTGTTTGCTCATTTTG | 461 |
| oVZ389 | AACTTAGCATTTTTGTTAATTGGTGTTTTGTTTAATAATGGGG | 462 |
| oVZ390 | AATTAACAAAAATGCTAAGTTTCATCACCGAAGC | 463 |
| oVZ391 | AACACCCAGCCTATGACTTTATACATGTAACGGATCCGTC | 464 |
| oVZ392 | GTTCTGGTGAGCTGGGTGTTTGCTCATTTTG | 465 |
| oVZ393 | AGACTGACATTTTTGTTAATTGGTGTTTTGTTTAATAATGGGG | 466 |
| oVZ394 | AATTAACAAAAATGTCAGTCTCGCCTTTCGTTG | 467 |
| oVZ395 | AACACCCAGCTCACCAGAACTTCCATTCTTTAACGTTTATC | 468 |
| oVZ396 | CGGTTTATAGGCTGGGTGTTTGCTCATTTTG | 469 |
| oVZ399 | AACACCCAGCCTATAAACCGATATAGTCCTCCCAGTTTTC | 470 |
| oVZ401 | CTGAATACATTTTTGTTAATTGGTGTTTTGTTTAATAATGGGG | 471 |
| oVZ402 | AATTAACAAAAATGTATTCAGCTTCAGTCACAGC | 472 |
| oVZ404 | GATTACTTTAAGCTGGGTGTTTGCTCATTTTG | 473 |
| oVZ405 | CTGATGACATTTTTGTTAATTGGTGTTTTGTTTAATAATGGGG | 474 |
| oVZ406 | AATTAACAAAAATGTCATCAGAATACGCTAAACTAGTGG | 475 |
| oVZ407 | AACACCCAGCTTAAAGTAATCTATGTATCTCAGTATCTTGGTACTTTTC | 476 |
| oVZ408 | ATCCAAATAGGCTGGGTGTTTGCTCATTTTG | 477 |
| oVZ409 | TATCAGACATTTTTGTTAATTGGTGTTTTGTTTAATAATGGGG | 478 |
| oVZ410 | AATTAACAAAAATGTCTGATAAAGCAGCCGCTAG | 479 |
| oVZ411 | AACACCCAGCCTATTTGGATCTCTTGTAAACCTTGCC | 480 |
| oVZ478 | TACCAAACTAAGCTGGGTGTTTGCTCATTTTG | 481 |
| oVZ479 | AACACCCAGCTTAGTTTGGTAACCCACTTTCGTTG | 482 |
| oVZ480 | CTTTTGCACATTTTTGTTAATTGGTGTTTTGTTTAATAATGGGG | 483 |
| oVZ481 | CCAATTAACAAAAATGTCAAAAGCTTTTAGTGCCCC | 484 |

Example 73: Promoters and Terminators

Certain promoters and terminators described herein are provided in Tables 28 and 29 below.

TABLE 28

| Promoter | Sequence | SEQ ID NO | Length |
|---|---|---|---|
| HDE1 | AAGGGAAGAAGAGTCGTTGAGTTGATGTAATT AAGCTGGCACGTAGATACCAGAAGGTTCTAG AGTAGAGCTTGGGTGGTGTTTGGCCCTGTTT GGACCACGGATAGAGATGGAGAATCCCTTGG TTAGAGCGGAGAGGAAAAAATTGAAACTTTGC ATATCCCACTTCATTATCCTTGATGTAACCGTT TTATGGGGTAATTAAAGTGTGGAAAAATAATC AGGGAGACATATTCCCGATCAATTGGGTGGT GGTCGCTCAATTTCTGTGAGTAGTAGGCTCAG | 485 | 751 |

TABLE 28-continued

| Promoter | Sequence | SEQ ID NO | Length |
|---|---|---|---|
| | TGGTGTGTATTGGGATTGGTAGTAGTCTGTAT<br>AAGCAGTGTTATATAACCCATTGCTTGTTGATT<br>CCTATTTTGCTGGCAAAAGTGACAACTGTAGT<br>TGTGAGATAATCCTCGGTTATTACGCCTGGGG<br>GGGCAGACAGCCAAAGTTGTGCCCGTGCGAC<br>AATGGCATCAGAAGAAACAGAAAAAAAAAACA<br>CAGGCATTTTTATCCACATGCACACTACCCCC<br>ACTATTCCTGTCTGCAGTGTGCTTGTGTGTGG<br>CCCCCCGCAGAATCAACAGGGCAAACTCTGG<br>AGCCTGAATCTTTATATAAACTTCAGGCATTG<br>GCCCCCTTTTCACAATTCTTCACATCCACCA<br>TTTTTTTTCTTCTTTCCTACCATATTAGTTTTTT<br>TTTATTCTTTTCCTACCTATCTGATTATTATCAA<br>ACATCTGGTCATCCTCAAAAGAAAGAAAGAAA<br>CTATAACAATCAATC | | |
| POX4 | GAGCTCCAATTGTAATATTTCGGGAGAAATAT<br>CGTTGGGGTAAAACAACAGAGAGAGAGAGGG<br>AGAGATGGTTCTGGTAGAATTATAATCTGGTT<br>GTTGCAAATGCTACTGATCGACTCTGGCAATG<br>TCTGTAGCTCGCTAGTTGTATGCAACTTAGGT<br>GTTATGCATACACACGGTTATTCGGTTGAATT<br>GTGGAGTAAAAATTGTCTGAGTTGTGTCTTAG<br>CTACTGGCTGGCCCCCCGCGAAAGATAATCA<br>AAATTACACTTGTGAATTTTTGCACACACACC<br>GATTAACATTTCCCTTTTTTGTCCACCGATACA<br>CGCTTGCCTCTTCTTTTTTTTCTCTGTGCTTCC<br>CCCTCCTGTGACTTTTTCCACCATTGATATAAA<br>ATCAACTCCATTTCCCTAAAATCTCCCCAGATT<br>CTAAAAACAACTTCTTCTCTTCTGCTTTTCCTT<br>TTTTTTTGTTATATTTATTTACCATCCCTTTTTT<br>TTGAATAGTTATTCCCCACTAACATTGTTCAAA<br>TCTTCACGACATA | 486 | 531 |
| URA3 | CGACGGGTACAACGAGAATTGTATTGAATTGA<br>TCAAGAACATGATCTTGGTGTTACAGAACATC<br>AAGTTCTTGGACCAGACTGAGAATGCACAGAT<br>ATACAAGGCGTCATGTGATAAAATGGATGAGA<br>TTTATCCACAATTGAAGAAAGAGTTTATGGAA<br>AGTGGTCAACCAGAAGCTAAACAGGAAGAAG<br>CAAACGAAGAGGTGAAACAAGAAGAAGAAGG<br>TAAATAAGTATTTTGTATTATATAACAAACAAA<br>GTAAGGAATACAGATTTATACAATAAATTGCC<br>ATACTAGTCACGTGAGATATCTCATCCATTCC<br>CCAACTCCCAAGAAAAAAAAAAGTGAAAAAA<br>AAAATCAAACCCAAAGATCAACCTCCCCATCA<br>TCATCGTCATCAAACCCCCAGCTCAATTCGCA | 487 | 415 |
| G6PI | AAAATCAGAGGCTACTCCGGAGATGGCACAT<br>TATCACGTGGGCAGTCCCATCTCTCTGACAAT<br>GGCACTGACAATGCCATGTCATTCTAGAAGTC<br>GCTCGTTCCATTGCTAGTCGTGTAGGTGTCTT<br>ACTCAGACCATATGTTTGGCTGTGTGTGTGGT<br>AAGGGGGTAAGATATCTCTAGGAGGAGGCAA<br>CTCTACTCGAAAGTACGAAATGGCCGACGCC<br>AATCCGACCTGCCATTGTGCAGGACGCGGGT<br>CGAGATCCGGAAGTGCCCTCCTTCTGAGGTT<br>GTTGGTTTGTTCCAGTTGGCATAAGAAATTAA<br>TAATCGTTTAGTCAATGGTACAGTATTAATAAT<br>TCCTGACAAAACCGTGCCCTACAAGCAGTGT<br>GAGTTCCGGGGGTAGCACTAGTGGTCGTGGT<br>GGTAGGGCCCACAGAGAGTATTTCCGGAACC<br>GACTGATCCTTTGATTCCAATATTCCAAGATTT<br>GGGTTTGTGGTTGTGTAATGCATGAGGTTA<br>TTTTGTCAACCTCCTTCCTTCTCTACGGTTGTT<br>GCTCCTCCTCCTCTTCCTTCCCTTTGTTCATTT<br>AAATACACACACACCACTCCCCTTCCCACCCA<br>CAAGAACTTTTTTTTTTTTACTTTCTTCTTCTC<br>TTACTTTCTTCTTCTTCTTTCATTACCTGTTAG<br>ATTATATTTATCAACCTCAATTGGTTTATTATCT<br>ACCACCCATACAACCCCCACCCCTGCCACAT<br>CCACCAACA | 488 | 745 |
| GPD | CGGAAGTTGTTTACCGACCTGACCGTAAATTT<br>GCTGCTGAAAGAAACGTGTCAAACAAGACCA<br>ATTGGCTCAATTGACCCTGTGGAAATGCTTTG<br>TTGACCACCAATGCTTCCACCAAACGTTACTT<br>TTTTTTTTGCAATCGGATGGTATGGGTCTGGGG | 489 | 614 |

TABLE 28-continued

| Promoter | Sequence | SEQ ID NO | Length |
|---|---|---|---|
| | TTCACCTGTTTTGTAAAGCTACAGAAGGTGGC ATATTTCTCTGATCAGGTGTTTTTTTTTTCGGC TGCTGCTGCTCGTGGTGGTGTAGTGGTAGTG GTGTGTGTGTGTGTGTGCGTGCGTGTGGA AGGACGCTTTTTGCTCTCTGACTCCTCCCAAT CAGAAGTTGCTATAGTGGTGAAACAACAATGG ATGATAATGCCCCGGGCGGTGCGTGTCCGAC ACAAACCACTACATTTTTTAGCTGGGAGCCTA CTGCCACTACGACCCACCCACCCATGGTCAA CAAAAAAATTCTGACAAATTATAAAATAACCCT TGAATTCCCCCTTGGAAAAATTTTTGGTATTTC TCTCTCTCTTTTCCTTTCCCTCTTCTTTTTCTCT CCATCAATCAATTGACGTTCAGTAACTCAATTA ATTACATCACATCCCTCAATTAAAGAATTTAAT CGAT | | |
| POX18 | AGATAAACCGAGGCATGGAAGAAGTCAGAGA CTTCCTAATTGGGAAATATCACATGAAAATGT ATGGATGTGTGCAGGACACGTCTACTGAGTG CCATACTTTGTGCCCACCGCGAAATTAAGGG CAGCCATCAGATTACGTAAGCAGTGGTATGCA GTTGTTACAGCGTCAAGTTTTTCTGTATTACC CCAAAGTTTTCTTCTCTCCCCTGCAAAAGTTTT CATATGCAAAACTGATCCCACAGCAGTATAAA TACCCAATAACTTTCCCCAACCAACAGCAACA ACCTCTCATTCTTTTTTTTCCTATTCTTTTCTTT AATCAACCCCCATTATTAAACAAAACACCAATT AACAAAA | 490 | 360 |
| LEU2 | GTCTTGCACGCTTTGGGTGCCGACGACGCCT TGGCCCACTCAAGTATTAGATTCGGTATTGGT AGATTCACCACTGAGGCAGAGGTCGACTATG TCATCAAGGCTATTAACGAAAGAGTTGATTTC TTGAGAAAGATGTCTCCATTGTGGGAGATGGT GCAAGAAGGCATTGACTTGGACTCAATTGAAT GGAGTGGTCATTAGTGTGACCCCCTATCGCT ACGGTCTTCCTCTTCGTTTCATTTAAGTATGAC TTGTTTTGTTTATTTATCTCGTGTATAGAATAG TAATTATTTTTGGTATAAGCCATGTTGGTATTC GTGAGTCAGATGTGAGCTGTATGTTCTCCTGA ACCGGCGTAACTTCCCTTCCGTTGCCGCGGG AATGCGACAACAACGACGGGAAAAAAATCCC AGTATAAAACCACCCCAAATGACGTGTGTGAA ATTTTTCACTCCAGGTTTCTCTCCCTCTTTTTT GTCCCCCCAAACCAATCACCA | 491 | 500 |

TABLE 29

| Terminator | Sequence | SEQ ID NO | Length |
|---|---|---|---|
| POX4 | GAATAGAAGAGAGTGACTCTTTTGATAAGAGT CGCAAATTTGATTTCATAAGTATATATTCATTA TGTAAAGTAGTAAATGGAAAATTCATTAAAAAA AAAGCAAATTTCCGTTGTATGCATACTCCGAA CACAAAACTAGCCCCGGAAAAACCCTTAGTTG ATAGTTGCGAATTTAGGTCGAC | 492 | 184 |
| URA3 | TAAATATTGTAATAAATAGGTCTATATACATAC ACTAAGCTTCTAGGACGTCATTGTAGTCTTCG AAGTTGTCTGCTAGTTTAGTTCTCATGATTTCG AAAACCAATAACGCAATGGATGTAGCAGGGAT GGTGGTTAGTGCGTTCCTGACAAACCCAGAG TACGCCGCCTCAAACCACGTCACATTCGCCC TTTGCTTCATCCGCATCACTTGCTTGAAGGTA TCCACGTACGAGTTGTAATACACCTTGAAGAA CGGCTTCGTCT | 493 | 267 |
| POX18 | GCTGGGTGTTTGCTCATTTTGTTTCAATGCAT GGATGCACACTGGTCTTTTTATGATTTGAAAT GAATAGATTTGATCATCATCATTTTTTTTTGC AAATATTTATCATATAATGTGAGTTTTCTTTGG TGTATATTTGTTTTCTACAGTATTTAGATAATAT TATTTGAAAAGAATATATGCTTAAAAGAAACTA CAAGTTAGAGTTCGACGATGAAGTGGTTGTCA | 494 | 374 |

TABLE 29-continued

| Terminator | Sequence | SEQ ID NO | Length |
|---|---|---|---|
| | TGTCGGCGACTTTACCCCAGAGTAAGAAGGA ATTGTCGTGGTCGATATTGGTTGAAACATATC GGGACTAGTCTTGCGACCGAGCGCAGGGCAA TTGTGGAGTCACACATACAATGAAAATTGGCT GCTTACTTGCAGTCTATGC | | |
| LEU2 | GGATCCTCTACATATGAACATTCTATATTGAAA AATGCATGTATATTATTGTCGTTAACGTTTTTT AAAAATTCATGGTCTTTTCTAAAAATGCAGATA GTTGAGCAACAGAATCCTCTTTATCAATCACC ACAACCACCGACTGTTTGCTACTCTCATTCGT AACAATGAATCTATTCGACGTGACCGTAGCCT CACTAGACTCAGATTGGCTGGTGTTCCTCGCA AGATTGGGTTCTTCATTAGGCGAGTAAAACTC CTCTTCCTCGTCCTCCTCCCCATCTTCGCTCG TGCTAGTCA | 495 | 300 |

Example 74: Strains

Certain strains described herein are further characterized in Table 30 below.

TABLE 30

| Strain No. | Description | Construction |
|---|---|---|
| sAA001 | *Candida viswanathii* ATCC 20336 | Acquired from ATCC |
| sAA002 | *Candida viswanathii* ATCC 20913, Δura3 | Acquired from ATCC |
| sAA4377 | Δpox4, Δfaa1, Δfat1, Δcrc1, Δura3 | Described in Example 21 and Table 11 |
| sAA5733 | ald6/ald6::URA3, crc1::ura3 promoter/CRC1 | Described in International Patent Application Publication No. WO2016/154046 |
| sAA5761 | ald6/ald6, crc1::ura3 promoter/ CRC1 | 5'FOA of sAA5733 |
| sAA6234 | crc1::ura3 promoter/crc1::ura3 promoter, ald6::ura3 promoter/ald6::ura3 promoter | 5'FOA of sAA5761 + pAA1701 |
| sAA7443 | GPD promoter - CsCrtE CvCO, GPD promoter - CsCrtB CvCO, GPD promoter - CsCrtI CvCO | sAA002 + PCR cassettes amplified from pAA2698, pAA2699, and pAA2700 using primers oAA02206 and oAA02209 |
| sAA7444 | GPD promoter - CsCrtE CvCO, GPD promoter - CsCrtB CvCO, GPD promoter - CsCrtI CvCO | sAA002 + PCR cassettes amplified from pAA2698, pAA2699, and pAA2700 using primers oAA02206 and oAA02209 |
| sAA7445 | GPD promoter - CsCrtE CvCO, GPD promoter - CsCrtB CvCO, GPD promoter - CsCrtI CvCO | sAA002 + PCR cassettes amplified from pAA2698, pAA2699, and pAA2700 using primers oAA02206 and oAA02209 |
| sAA7446 | HDE1 promoter - CsCrtE CvCO, HDE1 promoter - CsCrtB CvCO, HDE1 promoter - CsCrtI CvCO | sAA002 + PCR cassettes amplified from pAA2702, pAA2703 , and pAA2704 using primers oAA02206 and oAA02209 |
| sAA7449 | GPD promoter - CnTPS1 CvCO | sAA002 + PCR cassettes amplified from pAA2701 using primers oAA02206 and oAA02209 |
| sAA7453 | HDE1 promoter-CnTPS1 CvCO | sAA0002 + PCR cassettes amplified from pAA2705 using primers oAA02206 and oAA02209 |
| sAA7565 | crc1::ura3 promoter/crc1::ura3 promoter, ald6::ura3 promoter/ald6::ura3 promoter, HDE1 promoter - CsCrtE CvCO, HDE1 promoter - CsCrtB CvCO, HDE1 promoter - CsCrtI CvCO | sAA06234 + PCR cassettes amplified from pAA2702, pAA2703, pAA2704, and pAA2311 using primers oAA02206 and oAA02209 |

TABLE 30-continued

| Strain No. | Description | Construction |
|---|---|---|
| sAA7870 | GPD promoter - CsCrtE CvCO, GPD promoter - CsCrtI CvCO, GPD promoter - XdCrtYB CvCO, GPD promoter - XdCrtR CvCO, GPD promoter - AaCrtZ CvCO, GPD promoter - XdCrtS CvCO, GPD promoter - AaCrtW CvCO | sAA002 + PCR cassettes amplified from pAA2698, pAA2866, pAA2700, pAA2993, pAA2994, pAA2995, and pAA2996 using primers oAA02206 and oAA02209 |
| sAA7882 | GPD promoter - CsCrtE CvCO, GPD promoter - CsCrtI CvCO, GPD promoter - XdCrtYB CvCO | sAA002 + PCR cassettes amplified from pAA2698, pAA2866, and pAA2700 using primers oAA02206 and oAA02209 |
| sAA8283 | Δpox4, Δfaa1, Δfat1, Δcrc1, Δura3, G6Plpromoter- CRC1, HDE1 promoter - CsCrtE CvCO, HDE1 promoter - CsCrtB CvCO, HDE1 promoter - CsCrtI CvCO | sAA4377 + PCR cassettes amplified from pAA2311, pAA2702, pAA2703, sAA2704 |
| sAA8519 | Δpox4, Δfaa1, Δfat1, Δcrc1, Δura3, G6Plpromoter-CRC1, HDE1 promoter - CsCrtE CvCO, HDE1 promoter - XdCrtYB CvCO, HDE1 promoter - CsCrtI CvCO | sAA4377 + PCR cassettes amplified from pAA2311, pAA2702, pAA3373, sAA2704 |
| sAA8503 | GPD promoter - XdCrtE CvCO, GPD promoter - CsCrtB CvCO, GPD promoter - CsCrtI CvCO | sAA002 + PCR cassettes amplifieid from pAA3189, pAA2699, and pAA2700 |
| sAA8932 | GPD promoter - XdCrtE CvCO, GPD promoter - CsCrtB CvCO, GPD promoter - XdCrtI CvCO | sAA002 + PCR cassettes amplifieid from pAA3189, pAA2699, and pAA3490 |
| sAA9432 | HDE1 promoter - XdCrtE CvCO, HDE1 promoter - CsCrtB CvCO, HDE1 promoter - XdCrtI CvCO | sAA002 + PCR cassettes amplified from pAA3633, pAA2703, and pAA3634 |
| sAA9539 | Δras2/RAS2, Δura3 | sAA002 + pVZ3930, after 5'FOA |
| sAA9670 | Δras2/RAS2, HDE1 promoter - XdCrtE CvCO, HDE1 promoter - CsCrtB CvCO, HDE1 promoter - XdCrtI CvCO | sAA9539 + PCR cassettes amplified from pAA3633, pAA2703, and pAA3634 |
| sAA9658 | Δura3, Δleu2::tURA3/LEU2 | sAA002 + pAA3060 (BamHI/PstI) after 5'FOA |
| sAA9682 | Δras2/RAS2, Δura3, Δleu2::tURA3/LEU2 | sAA9539 + pAA3060 (BamHI/PstI) after 5'FOA |
| sAA9684 | Δura3, Δleu2 | sAA9658 + pAA2417 (BamHI/PstI) after 5'FOA |
| sAA9703 | Δras2/RAS2, Δura3, Δleu2 | sAA9682 + pAA3060 (BamHI/PstI) after 5'FOA |
| sAA9748 | Δleu2, HDE1 promoter - XdCrtE CvCO (URA3), HDE1 promoter - CsCrtB CvCO (URA3), HDE1 promoter - XdCrtI CvCO (URA3) | sAA9684 + PCR cassettes amplified from pAA3633, pAA2703, and pAA3634 |
| sAA9750 | Δleu2, Δras2/RAS2, HDE1 promoter - XdCrtE CvCO (URA3), HDE1 promoter - CsCrtB CvCO (URA3), HDE1 promoter - XdCrtI CvCO (URA3) | sAA9703 + PCR cassettes amplified from pAA3633, pAA2703, and pAA3634 |
| sAA9812 | HDE1 promoter - XdCrtE CvCO (URA3), HDE1 promoter - CsCrtB CvCO (URA3), HDE1 promoter - XdCrtI CvCO (URA3) + leu2 library of (Ppox18Erg10, Ppox18Erg13, Ppox18HMG1, Ppox18Erg12, Ppox18Erg8, Ppox18Mvd1, Ppox18IDI1, Ppox18Erg20 | sAA9748 + PCR cassettes amplified from pVZ4098, pVZ4099, pVZ4100, pVZ4101, pVZ4122, pVZ4123, pVZ4104, pVZ4105 |
| sAA9811 | HDE1 promoter - XdCrtE CvCO (URA3), HDE1 promoter - CsCrtB CvCO (URA3), HDE1 promoter - XdCrtI CvCO (URA3) + leu2 library of (Phde-XdCrtE, Phde-CsCrtB, Phde-XdCrtI) | sAA9748 + PCR cassettes amplified from pVZ4056, pVZ4057, pVZ4058 |
| sAA9814 | HDE1 promoter - XdCrtE CvCO (URA3), HDE1 promoter - CsCrtB CvCO (URA3), HDE1 promoter - XdCrtI CvCO (URA3) + leu2 library of (Phde-XdCrtE, Phde-CsCrtB, Phde-XdCrtI, Ppox18Erg10, Ppox18Erg13, Ppox18HMG1, Ppox18Erg12, | sAA9748 + PCR cassettes amplified from pVZ4098, pVZ4099, pVZ4100, pVZ4101, pVZ4122, pVZ4123, pVZ4104, pVZ4105, pVZ4056, pVZ4057, pVZ4058 |

TABLE 30-continued

| Strain No. | Description | Construction |
|---|---|---|
| | Ppox18Mvd1, Ppox18IDI1, Ppox18Erg20) | |
| sAA9819 | Δras2/RAS2, HDE1 promoter-XdCrtE CvCO (URA3), HDE1 promoter - CsCrtB CvCO (URA3), HDE1 promoter - XdCrtI CvCO (URA3) + leu2 library of (Phde-XdCrtE, Phde-CsCrtB, Phde-XdCrtI) | sAA9750 + PCR cassettes amplified from pVZ4056, pVZ4057, pVZ4058 |
| sAA9817 | Δras2/RAS2, HDE1 promoter - XdCrtE CvCO (URA3), HDE1 promoter - CsCrtB CvCO (URA3), HDE1 promoter - XdCrtI CvCO (URA3) + leu2 library of (Ppox18Erg10, Ppox18Erg13, Ppox18HMG1, Ppox18Erg12, Ppox18Mvd1, Ppox18IDI1, Ppox18Erg20) | sAA9750 + PCR cassettes amplified from pVZ4098, pVZ4099, pVZ4100, pVZ4101, pVZ4122, pVZ4123, pVZ4104, pVZ4105 |
| sAA9821 | Δras2/RAS2, HDE1 promoter - XdCrtE CvCO (URA3), HDE1 promoter - CsCrtB CvCO (URA3), HDE1 promoter - XdCrtI CvCO (URA3) + leu2 library of (Ppox18Erg10, Ppox18Erg13, Ppox18HMG1, Ppox18Erg12, Ppox18Mvd1, Ppox18Erg20, Phde-XdCrtE, Phde-CsCrtB, Phde-XdCrtI) | sAA9750 + PCR cassettes amplified from pVZ4098, pVZ4099, pVZ4100, pVZ4101, pVZ4122, pVZ4123, pVZ4104, pVZ4105, pVZ4056, pVZ4057, pVZ4058 |

Example 75: Examples of Embodiments

The examples set forth below illustrate certain embodiments and do not limit the technology.

A1. A genetically modified microorganism, comprising: one or more heterologous nucleic acids encoding one or more terpene biosynthesis polypeptides, wherein expression of at least one of the heterologous nucleic acids is regulated by a nucleic acid that provides for fatty acid or alkane induction of expression of the terpene biosynthesis polypeptide.

A2. The microorganism of embodiment A1, wherein the microorganism is a fungus.

A3. The microorganism of embodiment A2, wherein the fungus is a yeast.

A4. The microorganism of embodiment A3, wherein the yeast is chosen from *Candida* spp, *Yarrowia* spp, *Rhodotorula* spp, *Rhodosporidium* spp, *Cryptococcus* spp, *Trichosporon* spp, *Lipomyces* spp, and *Blastobotrys* spp.

A5. The microorganism of any one of embodiments A1 to A4, wherein the one or more heterologous nucleic acids encode one or more terpene biosynthesis polypeptides chosen from terpene synthase, phytoene synthase, geranylgeranyl diphosphate synthase, phytoene desaturase, lycopene cyclase, bifunctional lycopene cyclase/phytoene synthase, β-carotene ketolase, β-carotene hydroxylase, astaxanthin synthase, zeaxanthin glucosyltransferase, valencene synthase, and cytochrome p450 reductase.

A6. The microorganism of any one of embodiments A1 to A5, wherein the fatty acid is a saturated fatty acid or an unsaturated fatty acid.

A7. The microorganism of any one of embodiments A1 to A6, wherein the fatty acid is chosen from one or more of oleic acid, palmitoleic acid, erucic acid, linoleic acid, palmitic acid, caproic acid, enanthic acid, caprylic acid pelargonic acid, capric acid, undecylic acid, lauric acid, myristic acid, pentadecanoic acid, margaric acid, stearic acid arachidic acid, behenic acid, tridecylic acid, and linolenic acid.

A7.1 The microorganism of any one of embodiments A1 to A5, wherein the alkane is chosen from one or more of hexane, heptane, nonane, decane, undecane, dodecane, tridecane, tetradecane, pentadecane, hexadecane, heptadecane, and octadecane A8. The microorganism of any one of embodiments A1 to A7.1, wherein the nucleic acid that provides for fatty acid or alkane induction of expression of a terpene biosynthesis polypeptide comprises a fatty acid response element or an alkane response element.

A9. The microorganism of embodiment A8, wherein the fatty acid response element comprises an oleic acid response element.

A9.1 The microorganism of embodiment A8, wherein the alkane response element comprises an alkane response element 1 (ARE1) sequence.

A10. The microorganism of any one of embodiments A1 to A9, wherein the nucleic acid that provides for fatty acid induction of expression of a terpene biosynthesis polypeptide comprises a promoter region chosen from promoter regions of genes encoding hydratase-dehydrogenase-epimerase (HDE), acyl co-A oxidase (POX), acyl co-A thiolase (POT), peroxin (PEX) and peroxisomal adenine nucleotide transporter protein (ANT1).

A11. The microorganism of any one of embodiments A1 to A10, wherein the microorganism is *Candida viswanathii*.

A12. The microorganism of any one of embodiments A1 to A10, wherein the microorganism is *Blastobotrys adeninivorans*.

A13. The microorganism of any one of embodiments A1 to A12, wherein the one or more heterologous nucleic acids encode phytoene synthase, geranylgeranyl diphosphate synthase and phytoene desaturase.

A14. The microorganism of embodiment A13, wherein expression of the heterologous nucleic acids encoding phytoene synthase, geranylgeranyl diphosphate synthase and phytoene desaturase is regulated by a promoter region of the gene encoding a hydratase-dehydrogenase-epimerase (HDE).

A14.1 The microorganism of embodiment A13, wherein expression of the heterologous nucleic acids encoding phytoene synthase, geranylgeranyl diphosphate synthase and phytoene desaturase is regulated by a promoter region of the gene encoding a *Candida* hydratase-dehydrogenase-epimerase (HDE).

A14.2 The microorganism of embodiment A13, A14 or A14.1, wherein expression of the heterologous nucleic acids encoding phytoene synthase, geranylgeranyl diphosphate synthase and phytoene desaturase is regulated by a terminator region of the gene encoding an acyl co-A oxidase 4 (POX4).

A14.3 The microorganism of embodiment A13, A14 or A14.1, wherein expression of the heterologous nucleic acids encoding phytoene synthase, geranylgeranyl diphosphate synthase and phytoene desaturase is regulated by a terminator region of the gene encoding a *Candida* acyl co-A oxidase 4 (POX4).

A15. The microorganism of any one of embodiments A1 to A12, wherein the one or more heterologous nucleic acids encode valencene synthase.

A16. The microorganism of embodiment A15, wherein expression of the heterologous nucleic acids encoding valencene synthase is regulated by a promoter region of the gene encoding a hydratase-dehydrogenase-epimerase (HDE).

A16.1 The microorganism of embodiment A15, wherein expression of the heterologous nucleic acids encoding valencene synthase is regulated by a promoter region of the gene encoding a *Candida* hydratase-dehydrogenase-epimerase (HDE).

A16.2 The microorganism of embodiment A15, A16 or A16.1, wherein expression of the heterologous nucleic acids encoding valencene synthase is regulated by a terminator region of the gene encoding an acyl co-A oxidase 4 (POX4).

A16.3 The microorganism of embodiment A15, A16 or A16.1, wherein expression of the heterologous nucleic acids encoding valencene synthase is regulated by a terminator region of the gene encoding a *Candida* acyl co-A oxidase 4 (POX4).

A17. The microorganism of any one of embodiments A1 to A12, wherein the one or more heterologous nucleic acids encode geranylgeranyl diphosphate synthase, phytoene desaturase and bifunctional lycopene cyclase/phytoene synthase.

A18. The microorganism of embodiment A17, wherein expression of the heterologous nucleic acids encoding geranylgeranyl diphosphate synthase, phytoene desaturase and bifunctional lycopene cyclase/phytoene synthase is regulated by a promoter region of the gene encoding a hydratase-dehydrogenase-epimerase (HDE).

A18.1 The microorganism of embodiment A17, wherein expression of the heterologous nucleic acids encoding geranylgeranyl diphosphate synthase, phytoene desaturase and bifunctional lycopene cyclase/phytoene synthase is regulated by a promoter region of the gene encoding a *Candida* hydratase-dehydrogenase-epimerase (HDE).

A18.2 The microorganism of embodiment A17, A18 or A18.1, wherein expression of the heterologous nucleic acids encoding geranylgeranyl diphosphate synthase, phytoene desaturase and bifunctional lycopene cyclase/phytoene synthase is regulated by a terminator region of the gene encoding an acyl co-A oxidase 4 (POX4).

A18.3 The microorganism of embodiment A17, A18 or A18.1, wherein expression of the heterologous nucleic acids encoding geranylgeranyl diphosphate synthase, phytoene desaturase and bifunctional lycopene cyclase/phytoene synthase is regulated by a terminator region of the gene encoding a *Candida* acyl co-A oxidase 4 (POX4).

A19. The microorganism of any one of embodiments A1 to A18.3, wherein the one or more heterologous nucleic acids encoding the one or more terpene biosynthesis polypeptides are endogenously expressed in a microorganism chosen from *Cronobacter* spp, *Callitropsis* spp, *Xanthophyllomyces* spp, *Agrobacterium* spp, and *Pantoea* spp.

A20. The microorganism of any one of embodiments A1 to A19, wherein the amount and/or activity of a Ras2 protein has been decreased.

A21. The microorganism of any one of embodiments A1 to A20, wherein the microorganism has been genetically modified to reduce or eliminate expression of an endogenous RAS2 gene.

A22. The microorganism of any one of embodiments A1 to A21, wherein the amount and/or activity of an Faa1 protein has been decreased.

A23. The microorganism of any one of embodiments A1 to A22, wherein the microorganism has been genetically modified to reduce or eliminate expression of an endogenous FAA1 gene.

A24. The microorganism of any one of embodiments A1 to A23, wherein the amounts and/or activities of one or more proteins chosen from acetyl-CoA C-acetyltransferase, HMG-CoA synthase, HMG-CoA reductase, mevalonate kinase, phosphomevalonate kinase, di phosphomevalonate decarboxylase, and isopentyl diphosphate delta isomerase, have been increased.

A25. The microorganism of any one of embodiments A1 to A24, wherein the microorganism has been genetically modified to increase expression of one or more endogenous genes chosen from ERG10, ERG13, HMG1, ERG12, ERG8, MVD1, and ID/1.

A26. The microorganism of any one of embodiments A1 to A25, wherein the amount and/or activity of dimethylallyltranstransferase or farnesyl diphosphate synthetase has been increased.

A27. The microorganism of any one of embodiments A1 to A26, wherein the microorganism has been genetically modified to increase expression of an endogenous ERG20 gene.

A28. The microorganism of embodiment A25, wherein expression of ERG10, ERG13, HMG1, ERG12, ERG8, MVD1, and/or ID/1 is regulated by a promoter region of the gene encoding oleate-induced peroxisomal protein (POX18).

A29. The microorganism of embodiment A25 or A28, wherein expression of ERG10, ERG13, HMG1, ERG12, ERG8, MVD1, and/or ID/1 is regulated by a terminator region of the gene encoding oleate-induced peroxisomal protein (POX18).

A30. The microorganism of embodiment A27, wherein expression of ERG20 is regulated by a promoter region of the gene encoding oleate-induced peroxisomal protein (POX18).

A31. The microorganism of embodiment A27 or A30, wherein expression of ERG20 is regulated by a terminator region of the gene encoding oleate-induced peroxisomal protein (POX18).

B1. A genetically modified microorganism, comprising:
one or more heterologous nucleic acids encoding one or more terpene biosynthesis polypeptides, and
a genetic modification that alters the expression of a polypeptide providing for transport of acetyl-carnitine in the microorganism.

B1.1 The microorganism of embodiment B1, wherein expression of at least one of the heterologous nucleic acids is regulated by a nucleic acid that provides for fatty acid or alkane induction of expression of the terpene biosynthesis polypeptide.

B1.2 The microorganism of embodiment B1, wherein expression of at least one of the heterologous nucleic acids is regulated by a nucleic acid that provides for glucose induction of expression of the terpene biosynthesis polypeptide.

B2. The microorganism of embodiment B1, B1.1 or B1.2, wherein the microorganism is a fungus.

B3. The microorganism of embodiment B2, wherein the fungus is a yeast.

B4. The microorganism of embodiment B3, wherein the yeast is chosen from *Candida* spp, *Yarrowia* spp, *Rhodotorula* spp, *Rhodosporidium* spp, *Cryptococcus* spp, *Trichosporon* spp, *Lipomyces* spp, and *Blastobotrys* spp.

B5. The microorganism of any one of embodiments B1 to B4, wherein the one or more heterologous nucleic acids encode one or more terpene biosynthesis polypeptides chosen from terpene synthase, phytoene synthase, geranylgeranyl diphosphate synthase, phytoene desaturase, lycopene cyclase, bifunctional lycopene cyclase/phytoene synthase, β-carotene ketolase, β-carotene hydroxylase, astaxanthin synthase, zeaxanthin glucosyltransferase, valencene synthase, and cytochrome p450 reductase.

B6. The microorganism of any one of embodiments B1 to B5, wherein the genetic modification reduces expression of the polypeptide providing for transport of acetyl-carnitine in the microorganism relative to a microorganism that does not have the genetic modification.

B6.1 The microorganism of embodiment B6, wherein the genetic modification is a disruption, deletion or knockout of (i) a polynucleotide that encodes a polypeptide providing for transport of acetyl-carnitine, or (ii) a promoter operably linked to a polynucleotide that encodes a polypeptide providing for transport of acetyl-carnitine, whereby endogenous activity of a polypeptide providing for transport of acetyl-carnitine is reduced or abolished.

B7. The microorganism of embodiment B6, further comprising a nucleic acid encoding a polypeptide providing for transport of acetyl-carnitine wherein expression of the nucleic acid encoding a polypeptide providing for transport of acetyl-carnitine is regulated by a promoter that provides for reduced expression relative to endogenous expression.

B7.1 The microorganism of embodiment B7, wherein the genetic modification comprises replacing the promoter of an endogenous gene encoding the polypeptide providing for transport of acetyl-carnitine in the microorganism with a promoter that provides for reduced expression of the polypeptide in the microorganism relative to a microorganism that does not have the genetic modification.

B8. The microorganism of embodiment B7 or B7.1, wherein the promoter that provides for reduced expression relative to endogenous expression is a promoter for a glucose-6-phosphate isomerase (G6PI) gene.

B9. The microorganism of embodiment B7 or B7.1, wherein the promoter that provides for reduced expression relative to endogenous expression is a promoter for a *Candida* glucose-6-phosphate isomerase (G6PI) gene.

B10. The microorganism of any one of embodiments B1 to B9, wherein the polypeptide providing for transport of acetyl-carnitine in the microorganism is an acetyl-carnitine translocase (CRC).

B11. The microorganism of embodiment B10, wherein the acetyl-carnitine translocase (CRC) is acetyl-carnitine translocase 1 (CRC1).

B12. The microorganism of any one of embodiments B1 to B11, wherein the microorganism is *Candida viswanathii*.

B13. The microorganism of any one of embodiments B1 to B11, wherein the microorganism is *Blastobotrys adeninivorans*.

B14. The microorganism of any one of embodiments B1 to B13, wherein the one or more heterologous nucleic acids encode phytoene synthase, geranylgeranyl diphosphate synthase and phytoene desaturase.

B15. The microorganism of embodiment B14, wherein expression of the heterologous nucleic acids encoding phytoene synthase, geranylgeranyl diphosphate synthase and phytoene desaturase is regulated by a promoter region of the gene encoding a hydratase-dehydrogenase-epimerase (HDE).

B15.1 The microorganism of embodiment B14, wherein expression of the heterologous nucleic acids encoding phytoene synthase, geranylgeranyl diphosphate synthase and phytoene desaturase is regulated by a promoter region of the gene encoding a *Candida* hydratase-dehydrogenase-epimerase (HDE).

B15.2 The microorganism of embodiment B14, B15 or B15.1, wherein expression of the heterologous nucleic acids encoding phytoene synthase, geranylgeranyl diphosphate synthase and phytoene desaturase is regulated by a terminator region of the gene encoding an acyl co-A oxidase 4 (POX4).

B15.3 The microorganism of embodiment B14, B15 or B15.1, wherein expression of the heterologous nucleic acids encoding phytoene synthase, geranylgeranyl diphosphate synthase and phytoene desaturase is regulated by a terminator region of the gene encoding a *Candida* acyl co-A oxidase 4 (POX4).

B16. The microorganism of any one of embodiments B1 to B13, wherein the one or more heterologous nucleic acids encode geranylgeranyl diphosphate synthase, phytoene desaturase and bifunctional lycopene cyclase/phytoene synthase.

B17. The microorganism of embodiment B16, wherein expression of the heterologous nucleic acids encoding geranylgeranyl diphosphate synthase, phytoene desaturase and bifunctional lycopene cyclase/phytoene synthase is regulated by a promoter region of the gene encoding a hydratase-dehydrogenase-epimerase (HDE).

B17.1 The microorganism of embodiment B16, wherein expression of the heterologous nucleic acids encoding geranylgeranyl diphosphate synthase, phytoene desaturase and bifunctional lycopene cyclase/phytoene synthase is regulated by a promoter region of the gene encoding a *Candida* hydratase-dehydrogenase-epimerase (HDE).

B17.2 The microorganism of embodiment B16, B17 or B17.1, wherein expression of the heterologous nucleic acids encoding geranylgeranyl diphosphate synthase, phytoene desaturase and bifunctional lycopene cyclase/phytoene synthase is regulated by a terminator region of the gene encoding an acyl co-A oxidase 4 (POX4).

B17.3 The microorganism of embodiment B16, B17 or B17.1, wherein expression of the heterologous nucleic acids encoding geranylgeranyl diphosphate synthase, phytoene desaturase and bifunctional lycopene cyclase/phytoene synthase is regulated by a terminator region of the gene encoding a *Candida* acyl co-A oxidase 4 (POX4).

B18. The microorganism of any one of embodiments B1 to B17.3, wherein the one or more heterologous nucleic acids encoding the one or more terpene biosynthesis polypeptides are endogenously expressed in a microorganism chosen from *Cronobacter* spp, *Callitropsis* spp, *Xanthophyllomyces* spp, *Agrobacterium* spp, and *Pantoea* spp.

B19. The microorganism of any one of embodiments B1 to B18, wherein the amount and/or activity of a Ras2 protein has been decreased.

B20. The microorganism of any one of embodiments B1 to B19, wherein the microorganism has been genetically modified to reduce or eliminate expression of an endogenous RAS2 gene.

B21. The microorganism of any one of embodiments B1 to B20, wherein the amount and/or activity of an Faa1 protein has been decreased.

B22. The microorganism of any one of embodiments B1 to B21, wherein the microorganism has been genetically modified to reduce or eliminate expression of an endogenous FAA1 gene.

B23. The microorganism of any one of embodiments B1 to B22, wherein the amounts and/or activities of one or more proteins chosen from acetyl-CoA C-acetyltransferase, HMG-CoA synthase, HMG-CoA reductase, mevalonate kinase, phosphomevalonate kinase, diphosphomevalonate decarboxylase, and isopentyl diphosphate delta isomerase, have been increased.

B24. The microorganism of any one of embodiments B1 to B23, wherein the microorganism has been genetically modified to increase expression of one or more endogenous genes chosen from ERG10, ERG13, HMG1, ERG12, ERG8, MVD1, and ID/1.

B25. The microorganism of any one of embodiments B1 to B24, wherein the amount and/or activity of dimethylallyltranstransferase or farnesyl diphosphate synthetase has been increased.

B26. The microorganism of any one of embodiments B1 to B25, wherein the microorganism has been genetically modified to increase expression of an endogenous ERG20 gene.

B27. The microorganism of embodiment B24, wherein expression of ERG10, ERG13, HMG1, ERG12, ERG8, MVD1, and/or ID/1 is regulated by a promoter region of the gene encoding oleate-induced peroxisomal protein (POX18).

B28. The microorganism of embodiment B24 or B27, wherein expression of ERG10, ERG13, HMG1, ERG12, ERG8, MVD1, and/or ID/1 is regulated by a terminator region of the gene encoding oleate-induced peroxisomal protein (POX18).

B29. The microorganism of embodiment B26, wherein expression of ERG20 is regulated by a promoter region of the gene encoding oleate-induced peroxisomal protein (POX18).

B30. The microorganism of embodiment B26 or B29, wherein expression of ERG20 is regulated by a terminator region of the gene encoding oleate-induced peroxisomal protein (POX18).

C1. A genetically modified *Candida viswanathii* yeast, comprising one or more heterologous nucleic acids encoding one or more terpene biosynthesis polypeptides.

C1.1 The genetically modified *Candida viswanathii* yeast of embodiment C1, wherein expression of at least one of the heterologous nucleic acids is regulated by a nucleic acid that provides for fatty acid or alkane induction of expression of the terpene biosynthesis polypeptide.

C1.2 The genetically modified *Candida viswanathii* yeast of embodiment C1, wherein expression of at least one of the heterologous nucleic acids is regulated by a nucleic acid that provides for glucose induction of expression of the terpene biosynthesis polypeptide.

C2. The genetically modified *Candida viswanathii* yeast of embodiment C1, C1.1 or C1.2, wherein the one or more heterologous nucleic acids encode one or more terpene biosynthesis polypeptides chosen from terpene synthase, phytoene synthase, geranylgeranyl diphosphate synthase, phytoene desaturase, lycopene cyclase, bifunctional lycopene cyclase/phytoene synthase, β-carotene ketolase, β-carotene hydroxylase, astaxanthin synthase, zeaxanthin glucosyltransferase, valencene synthase, and cytochrome p450 reductase.

C3. The genetically modified *Candida viswanathii* yeast of any one of embodiments C1 to C2, wherein the one or more heterologous nucleic acids encode phytoene synthase, geranylgeranyl diphosphate synthase and phytoene desaturase C4. The genetically modified *Candida viswanathii* yeast of embodiment C3, wherein expression of the heterologous nucleic acids encoding phytoene synthase, geranylgeranyl diphosphate synthase and phytoene desaturase is regulated by a promoter region of the gene encoding a *Candida* hydratase-dehydrogenase-epimerase (HDE).

C4.1 The genetically modified *Candida viswanathii* yeast of embodiment C4, wherein expression of the heterologous nucleic acids encoding phytoene synthase, geranylgeranyl diphosphate synthase and phytoene desaturase is regulated by a terminator region of the gene encoding a *Candida* acyl co-A oxidase 4 (POX4).

C5. The genetically modified *Candida viswanathii* yeast of embodiment C3, wherein expression of the heterologous nucleic acids encoding phytoene synthase, geranylgeranyl diphosphate synthase and phytoene desaturase is regulated by a promoter region of the gene encoding a *Candida* glyceraldehyde-3-phosphate dehydrogenase (GPD).

C6. The genetically modified *Candida viswanathii* yeast of any one of embodiments C1 to C2, wherein the one or more heterologous nucleic acids encode valencene synthase.

C7. The genetically modified *Candida viswanathii* yeast of embodiment C6, wherein expression of the heterologous nucleic acids encoding valencene synthase is regulated by a promoter region of the gene encoding a *Candida* hydratase-dehydrogenase-epimerase (HDE).

C7.1 The genetically modified *Candida viswanathii* yeast of embodiment C7, wherein expression of the heterologous nucleic acids valencene synthase is regulated by a terminator region of the gene encoding a *Candida* acyl co-A oxidase 4 (POX4).

C8. The genetically modified *Candida viswanathii* yeast of embodiment C6, wherein expression of the heterologous nucleic acids encoding valencene synthase is regulated by a promoter region of the gene encoding a *Candida* glyceraldehyde-3-phosphate dehydrogenase (GPD).

C9. The genetically modified *Candida viswanathii* yeast of any one of embodiments C1 to C2, wherein the one or more heterologous nucleic acids encode geranylgeranyl diphosphate synthase, phytoene desaturase and bifunctional lycopene cyclase/phytoene synthase.

C10. The genetically modified *Candida viswanathii* yeast of embodiment C9, wherein expression of the heterologous nucleic acids encoding geranylgeranyl diphosphate synthase, phytoene desaturase and bifunctional lycopene cyclase/phytoene synthase is regulated by a promoter region of the gene encoding a *Candida* hydratase-dehydrogenase-epimerase (HDE).

C10.1 The genetically modified *Candida viswanathii* yeast of embodiment C10, wherein expression of the heterologous nucleic acids encoding geranylgeranyl diphosphate synthase, phytoene desaturase and bifunctional lycopene cyclase/phytoene synthase is regulated by a terminator region of the gene encoding a *Candida* acyl co-A oxidase 4 (POX4).

C11. The genetically modified *Candida viswanathii* yeast of embodiment C9, wherein expression of the heterologous nucleic acids encoding geranylgeranyl diphosphate synthase, phytoene desaturase and bifunctional lycopene cyclase/phytoene synthase is regulated by a promoter region of the gene encoding a *Candida* glyceraldehyde-3-phosphate dehydrogenase (GPD).

C12. The genetically modified *Candida viswanathii* yeast of any one of embodiments C1 to C2, wherein the one or more heterologous nucleic acids encode geranylgeranyl diphosphate synthase, phytoene desaturase, bifunctional lycopene cyclase/phytoene synthase, β-carotene ketolase, β-carotene hydroxylase, astaxanthin synthase, and cytochrome p450 reductase.

C13. The genetically modified *Candida viswanathii* yeast of embodiment C12, wherein expression of the heterologous nucleic acids encoding geranylgeranyl diphosphate synthase, phytoene desaturase, bifunctional lycopene cyclase/phytoene synthase, β-carotene ketolase, β-carotene hydroxylase, astaxanthin synthase, and cytochrome p450 reductase is regulated by a promoter region of the gene encoding a *Candida* hydratase-dehydrogenase-epimerase (HDE).

C13.1 The genetically modified *Candida viswanathii* yeast of embodiment C13, wherein expression of the heterologous nucleic acids encoding geranylgeranyl diphosphate synthase, phytoene desaturase, bifunctional lycopene cyclase/phytoene synthase, β-carotene ketolase, β-carotene hydroxylase, astaxanthin synthase, and cytochrome p450 reductase is regulated by a terminator region of the gene encoding a *Candida* acyl co-A oxidase 4 (POX4).

C14. The genetically modified *Candida viswanathii* yeast of embodiment C12, wherein expression of the heterologous nucleic acids encoding geranylgeranyl diphosphate synthase, phytoene desaturase, bifunctional lycopene cyclase/phytoene synthase, β-carotene ketolase, β-carotene hydroxylase, astaxanthin synthase, and cytochrome p450 reductase is regulated by a promoter region of the gene encoding a *Candida* glyceraldehyde-3-phosphate dehydrogenase (GPD).

C15. The genetically modified *Candida viswanathii* yeast of any one of embodiments C1 to C14, wherein the one or more heterologous nucleic acids encoding the one or more terpene biosynthesis polypeptides are endogenously expressed in a microorganism chosen from *Cronobacter* spp, *Callitropsis* spp, *Xanthophyllomyces* spp, *Agrobacterium* spp, and *Pantoea* spp.

C16. The genetically modified *Candida viswanathii* yeast of any one of embodiments C1 to C15, further comprising a genetic modification that alters the expression of one or more nucleic acids encoding one or more endogenous polypeptides.

C17. The genetically modified *Candida viswanathii* yeast of embodiment C16, wherein the one or more endogenous polypeptides are chosen from polypeptides having one or more of the following activities: acyl-CoA synthetase activity, acyl-CoA oxidase activity, ATP-binding cassette transporter activity, carnitine acetyltransferase activity, transport of acetyl-carnitine, acyl-CoA thioesterase activity, acyl-CoA hydrolase activity, aldehyde dehydrogenase activity, monooxygenase activity, or monooxgenase reductase activity.

C18. The genetically modified *Candida viswanathii* yeast of any one of embodiments C1 to C17, wherein the amount and/or activity of a Ras2 protein has been decreased.

C19. The genetically modified *Candida viswanathii* yeast of any one of embodiments C1 to C18, wherein the yeast has been genetically modified to reduce or eliminate expression of an endogenous RAS2 gene.

C20. The genetically modified *Candida viswanathii* yeast of any one of embodiments C1 to C19, wherein the amount and/or activity of an Faa1 protein has been decreased.

C21. The genetically modified *Candida viswanathii* yeast of any one of embodiments C1 to C20, wherein the yeast has been genetically modified to reduce or eliminate expression of an endogenous FAA1 gene.

C22. The genetically modified *Candida viswanathii* yeast of any one of embodiments C1 to C21, wherein the amounts and/or activities of one or more proteins chosen from acetyl-CoA C-acetyltransferase, HMG-CoA synthase, HMG-CoA reductase, mevalonate kinase, phosphomevalonate kinase, diphosphomevalonate decarboxylase, and isopentyl diphosphate delta isomerase, have been increased.

C23. The genetically modified *Candida viswanathii* yeast of any one of embodiments C1 to C22, wherein the yeast has been genetically modified to increase expression of one or more endogenous genes chosen from ERG10, ERG13, HMG1, ERG12, ERG8, MVD1, and ID/1.

C24. The genetically modified *Candida viswanathii* yeast of any one of embodiments C1 to C23, wherein the amount and/or activity of dimethylallyltranstransferase or farnesyl diphosphate synthetase has been increased.

C25. The genetically modified *Candida viswanathii* yeast of any one of embodiments C1 to C24, wherein the yeast has been genetically modified to increase expression of an endogenous ERG20 gene.

C26. The genetically modified *Candida viswanathii* yeast of embodiment C23, wherein expression of ERG10, ERG13, HMG1, ERG12, ERG8, MVD1, and/or ID/1 is regulated by a promoter region of the gene encoding oleate-induced peroxisomal protein (POX18).

C27. The genetically modified *Candida viswanathii* yeast of embodiment C23 or C26, wherein expression of ERG10, ERG13, HMG1, ERG12, ERG8, MVD1, and/or ID/1 is regulated by a terminator region of the gene encoding oleate-induced peroxisomal protein (POX18).

C28. The genetically modified *Candida viswanathii* yeast of embodiment C25, wherein expression of ERG20 is regulated by a promoter region of the gene encoding oleate-induced peroxisomal protein (POX18).

C29. The genetically modified *Candida viswanathii* yeast of embodiment C25 or C28, wherein expression of ERG20 is regulated by a terminator region of the gene encoding oleate-induced peroxisomal protein (POX18).

D1. A method for producing a terpene comprising:
   contacting the genetically modified microorganism of any one of embodiments A1 to A31 with a feedstock comprising a carbon source, and
   culturing the microorganism under conditions in which the terpenes are produced from the feedstock.

D2. A method for producing a terpene comprising:
   contacting the genetically modified microorganism of any one of embodiments B1 to B30 with a feedstock comprising a carbon source, and
   culturing the microorganism under conditions in which the terpenes are produced from the feedstock.

D3. A method for producing a terpene comprising:
contacting the genetically modified *Candida viswanathii* yeast of any one of embodiments C1 to C29 with a feedstock comprising a carbon source, and
culturing the microorganism under conditions in which the terpenes are produced from the feedstock.

D4. The method of any one of embodiments D1 to D3, wherein the feedstock comprises one or more fatty acids.

D5. The method of embodiment D4, wherein the feedstock comprises one or more saturated fatty acids or one or more unsaturated fatty acids; or one or more saturated fatty acids and one or more unsaturated fatty acids.

D6. The method of embodiment D4 or D5, wherein the feedstock comprises one or more fatty acids chosen from oleic acid, palmitoleic acid, erucic acid, linoleic acid, palmitic acid, caproic acid, enanthic acid, caprylic acid pelargonic acid, capric acid, undecylic acid, lauric acid, myristic acid, pentadecanoic acid, margaric acid, stearic acid arachidic acid, behenic acid, tridecylic acid, and linolenic acid.

D7. The method of embodiment D6 wherein the feedstock comprises oleic acid.

D8. The method of any one of embodiments D1 to D3, wherein the feedstock comprises one or more sugars.

D9. The method of D8, wherein the feedstock comprises glucose.

D10. The method of any one of embodiments D1 to D3, wherein the feedstock comprises one or more alkane hydrocarbons.

D10.1 The method of embodiment D10, wherein the feedstock comprises one or more alkane hydrocarbons chosen from one or more of hexane, heptane, nonane, decane, undecane, dodecane, tridecane, tetradecane, pentadecane, hexadecane, heptadecane, and octadecane.

D11. The method of embodiment D10, wherein the feedstock comprises one or more alkane hydrocarbons chosen from C10 to C14 alkane hydrocarbons, nonane and octadecane.

D12. The method of any one of embodiments D1 to D3, wherein the feedstock comprises one or more vegetable oils, derivatives thereof, or byproducts thereof.

D13. The method of embodiment D12, wherein the feedstock comprises crude palm oil (CPO).

D14. The method of embodiment D12, wherein the feedstock comprises palm oil fatty acid distillate (PFAD).

D15. The method of any one of embodiments D1 to D14, wherein the terpene is chosen from lycopene, beta carotene and astaxanthin.

D16. The method of any one of embodiments D1 to D15, wherein the yield or titer of the terpene is between about 0.001 g/L to about 2.0 g/L.

D16.1 The method of any one of embodiments D1 to D15, wherein the yield or titer of the terpene is between about 0.05 g/L to about 0.5 g/L.

D17. The method of any one of embodiments D1 to D15, wherein the yield or titer of the terpene is between about 0.001 g/L to about 0.2 g/L.

D18. The method of embodiment D16, wherein the yield or titer of lycopene is between about 0.03 g/L to about 2.0 g/L.

D18.1 The method of embodiment D16.1, wherein the yield or titer of lycopene is between about 0.05 g/L to about 0.5 g/L.

D19. The method of embodiment D17, wherein the yield or titer of lycopene is between about 0.001 g/L to about 0.2 g/L.

D20. The method of embodiment D16, wherein the yield or titer of beta carotene is between about 0.1 g/L to about 0.2 g/L.

D21. The method of embodiment D17, wherein the yield or titer of beta carotene is between about 0.01 g/L to about 0.1 g/L.

D22. The method of embodiment D17, wherein the yield or titer of beta carotene is between about 0.001 g/L to about 0.01 g/L.

D23. The method of embodiment D16, wherein the yield or titer of astaxanthin is between about 0.005 g/L to about 0.01 g/L.

D24. The method of embodiment D17, wherein the yield or titer of astaxanthin is between about 0.001 g/L to about 0.005 g/L.

D25. The method of any one of embodiments D1 to D24, further comprising isolating the terpene.

E1. A genetically modified yeast comprising one or more heterologous nucleic acids encoding phytoene synthase, geranylgeranyl diphosphate synthase and phytoene desaturase.

E2. A genetically modified yeast comprising one or more heterologous nucleic acids encoding geranylgeranyl diphosphate synthase, phytoene desaturase and bifunctional lycopene cyclase/phytoene synthase.

E3. A genetically modified yeast comprising one or more heterologous nucleic acids encoding geranylgeranyl diphosphate synthase, phytoene desaturase, bifunctional lycopene cyclase/phytoene synthase, β-carotene ketolase, β-carotene hydroxylase, astaxanthin synthase, and cytochrome p450 reductase.

E4. The genetically modified yeast of embodiment E1, E2 or E3, wherein the amount and/or activity of a Ras2 protein has been decreased.

E5. The genetically modified yeast of any one of embodiments E1 to E4, wherein the yeast has been genetically modified to reduce or eliminate expression of an endogenous RAS2 gene.

E6. The genetically modified yeast of any one of embodiments E1 to E5, wherein the amount and/or activity of an Faa1 protein has been decreased.

E7. The genetically modified yeast of any one of embodiments E1 to E6, wherein the yeast has been genetically modified to reduce or eliminate expression of an endogenous FAA1 gene.

E8. The genetically modified yeast of any one of embodiments E1 to E7, wherein the amounts and/or activities of one or more proteins chosen from acetyl-CoA C-acetyltransferase, HMG-CoA synthase, HMG-CoA reductase, mevalonate kinase, phosphomevalonate kinase, diphosphomevalonate decarboxylase, and isopentyl diphosphate delta isomerase, have been increased.

E9. The genetically modified yeast of any one of embodiments E1 to E8, wherein the yeast has been genetically modified to increase expression of one or more endogenous genes chosen from ERG10, ERG13, HMG1, ERG12, ERGS, MVD1, and ID/1.

E10. The genetically modified yeast of any one of embodiments E1 to E9, wherein the amount and/or activity of dimethylallyltranstransferase or farnesyl diphosphate synthetase has been increased.

E11. The genetically modified yeast of any one of embodiments E1 to E10, wherein the yeast has been genetically modified to increase expression of an endogenous ERG20 gene.

E12. The genetically modified yeast of any one of embodiments E1 to E11, wherein the yeast is *Candida viswanathii*.

E13. The genetically modified yeast of any one of embodiments E1 to E11, wherein the yeast is *Blastobotrys adeninivorans*.

E14. Use of the genetically modified yeast of any one of embodiments E1 to E13 for the production of a terpene.

E15. Use of the genetically modified yeast of any one of embodiments E1 and E4 to E14 for the production of lycopene.

E16. Use of the genetically modified yeast of any one of embodiments E2 and E4 to E14 for the production of beta carotene.

E17. Use of the genetically modified yeast of any one of embodiments E3 to E14 for the production of astaxanthin.

The entirety of each patent, patent application, publication and document referenced herein hereby is incorporated by reference. Citation of the above patents, patent applications, publications and documents is not an admission that any of the foregoing is pertinent prior art, nor does it constitute any admission as to the contents or date of these publications or documents. Their citation is not an indication of a search for relevant disclosures. All statements regarding the date(s) or contents of the documents is based on available information and is not an admission as to their accuracy or correctness.

Modifications may be made to the foregoing without departing from the basic aspects of the technology. Although the technology has been described in substantial detail with reference to one or more specific embodiments, those of ordinary skill in the art will recognize that changes may be made to the embodiments specifically disclosed in this application, yet these modifications and improvements are within the scope and spirit of the technology.

The technology illustratively described herein suitably may be practiced in the absence of any element(s) not specifically disclosed herein. Thus, for example, in each instance herein any of the terms "comprising," "consisting essentially of," and "consisting of" may be replaced with either of the other two terms. The terms and expressions which have been employed are used as terms of description and not of limitation, and use of such terms and expressions do not exclude any equivalents of the features shown and described or portions thereof, and various modifications are possible within the scope of the technology claimed. The term "a" or "an" can refer to one of or a plurality of the elements it modifies (e.g., "a reagent" can mean one or more reagents) unless it is contextually clear either one of the elements or more than one of the elements is described. The term "about" as used herein refers to a value within 10% of the underlying parameter (i.e., plus or minus 10%), and use of the term "about" at the beginning of a string of values modifies each of the values (i.e., "about 1, 2 and 3" refers to about 1, about 2 and about 3). For example, a weight of "about 100 grams" can include weights between 90 grams and 110 grams. Further, when a listing of values is described herein (e.g., about 50%, 60%, 70%, 80%, 85% or 86%) the listing includes all intermediate and fractional values thereof (e.g., 54%, 85.4%). Thus, it should be understood that although the present technology has been specifically disclosed by representative embodiments and optional features, modification and variation of the concepts herein disclosed may be resorted to by those skilled in the art, and such modifications and variations are considered within the scope of this technology.

Certain embodiments of the technology are set forth in the claim(s) that follow(s).

SEQUENCE LISTING (527 sequences)

SEQ ID NO: 1 - protein, 267 aa, Candida viswanathii
MVSTKTYTERASAHPSKVAQRLFRLMESKKTNLCASIDVTTTAEFLSLIDKLGPHICLVKTHIDIISDFSYEGTIEPLLVLAERHGFLIFEDRKFADIGNTVMLQYTSGVYRIAAWSDITNAHGVTGKGVVEGLKRGAEGVEKERGVLMLAELSSKGSLAHGEYTRETIEIAKSDREFVIGFIAQRDMGGREEGFDWIIMTPGVGLDDKGDALGQQYRTVDEVVLTGTDVIIVGRGLFGKGRDPEVEGKRYRDAGWKAYLKRTGQLE

SEQ ID NO: 2 - protein, 627 aa, Candida viswanathii
MFNFKLSQQVLKNSTKSIMPILKKPFSTSHAKGDLFKYQSQLPKLPVPTLEETASKYLKTVEPFLNQEQLESTKAKVAEFVRPGGAGEALQARLNNFAADKDNWLAEFWDDYAYMSYRDPVVPYVSYFFSHKDVKNIIGQDQLLKATLIAYYTIEFQEKVLDESLDPEVIKGNPFCMNAFKYMFNNSRVPAEGSDITQHYNGEENQFFVVIYKNNFYKVPTHKNGQRLTKGEIYSYLQEIKNDATPKGLGLGALTSLNRDEWLSAYNNLLKSPINEASLGSIFASSFVIALDSNNPVTIEEKSKNCWHGDGQNRFFDKPLEFFVSANGNSGFLGEHSRMDATPTVQLNNTIYKQILETNPNDLIVEIGSSAPRFGNAEILPFDINPTTRANIKDAIAKFDATIAAHDEEIFQHYGYGKGLIKKFKVSPDAYVQLLMQLAYFKYTGKIRPTYESAATRKFLKGRTETGRTVSNESKKFVETWSDPNASSADKVATFQAAAKQHVAYLSAAADGKGVDRHLFGLKQMIQPGEPIPEIFTDPIFSYSQTWYISSSQVPSEFFQSWGWSQVIDDGFGLAYLINNDWIHVHISCKRGNGLQSDHLKWYLVDSANEMKDVLTKGLLTDAKPKL

SEQ ID NO: 3 - protein, 609 aa, Artificial Sequence
  Description of Artificial Sequence: Synthetic polypeptide
MPILKKPFSTSHAKGDLFKYQSQLPKLPVPTLEETASKYLKTVEPFLNQEQLESTKAKVAEFVRPGGAGEALQARLNNFAADKDNWLAEFWDDYAYMSYRDPVVPYVSYFFSHKDVKNIIGQDQLLKATLIAYYTIEFQEKVLDESLDPEVIKGNPFCMNAFKYMFNNSRVPAEGSDITQHYNGEENQFFVVIYKNNFYKVPTHKNGQRLTKGEIYSYLQEIKNDATPKGLGLGALTSLNRDEWLSAYNNLLKSPINEASLGSIFASSFVIALDSNNPVTIEEKSKNCWHGDGQNRFFDKPLEFFVSANGNSGFLGEHSRMDATPTVQLNNTIYKQILETNPNDLIVEIGSSAPRFGNAEILPFDINPTTRANIKDAIAKFDATIAAHDEEIFQHYGYGKGLIKKFKVSPDAYVQLLMQLAYFKYTGKIRPTYESAATRKFLKGRTETGRTVSNESKKFVETWSDPNASSADKVATFQAAAKQHVAYLSAAADGKGVDRHLFGLKQMIQPGEPIPEIFTDPIFSYSQTWYISSSQVPSEFFQSWGWSQVIDDGFGLAYLINNDWIHVHISCKRGNGLQSDHLKWYLVDSANEMKDVLTKGLLTDAKPKL

SEQ ID NO: 4 - protein, 606 aa, Artificial Sequence
  Description of Artificial Sequence: Synthetic polypeptide
MPILKKPFSTSHAKGDLFKYQSQLPKLPVPTLEETASKYLKTVEPFLNQEQLESTKAKVAEFVRPGGAGEALQARLNNFAADKDNWLAEFWDDYAYMSYRDPVVPYVSYFFSHKDVKNIIGQDQLLKATLIAYYTIEFQEKVLDESLDPEVIKGNPFCMNAFKYMFNNSRVPAEGSDITQHYNGEENQFFVVIYKNNFYKVPTHKNGQRLTKGEIYSYLQEIKNDATPKGLGLGALTSLNRDEWLSAYNNLLKSPINEASLGSIFASSFVIALDSNNPVTIEEKSKNCWHGDGQNRFFDKPLEFFVSANGNSGFLGEHSRMDATPTVQLNNTIYKQILETNPNDLIVEIGSSAPRFGNAEILPFDINPTTRANIKDAIAKFDATIAAHDEEIFQHYGYGKGLIKKFKVSPDAYVQLLMQLAYFKYTGKIRPTYESAATRKFLKGRTETGRTVSNESKKFVETWSDPNASSADKVATFQAAAKQHVAYLSAAADGKGVDRHLFGLKQMIQPGEPIPEIFTDPIFSYSQTWYISSSQVPSEFFQSWGWSQVIDDGFGLAYLINNDWIHVHISCKRGNGLQSDHLKWYLVDSANEMKDVLTKGLLTDAK

SEQ ID NO: 5 - protein, 624 aa, Artificial Sequence
  Description of Artificial Sequence: Synthetic polypeptide
MFNFKLSQQVLKNSTKSIMPILKKPFSTSHAKGDLFKYQSQLPKLPVPTLEETASKYLKTVEPFLNQEQLESTKAKVAEFVRPGGAGEALQARLNNFAADKDNWLAEFWDDYAYMSYRDPVVPYVSYFFSHKDVKNIIGQDQLLKATLIAYYTIEFQEKVLDESLDPEVIKGNPFCMNAFKYMFNNSRVPAEGSDITQHYNGEENQFFVVIYKNNFYKVPTHKNGQRLTKGEIYSYLQEIKNDATPKGLGLGALTSLNRDEWLSAYNNLLKSPINEASLGSIFASSFVIALDSNNPVTIEEKSKNCWHGDGQNRFFDKPLEFFVSANGNSGFLGEHSRMDATPTVQLNNTIYKQILETNPNDLIVEIGSSAPRFGNAEILPFDINPTTRANIKDAIAKFDATIAAHDEEIFQHYGYGKGLIKKFKVSPDAYVQLLMQLAYFKYTGKIRPTYESAATRKFLKGRTETGRTVSNESKKFVETWSDPNASSADKVATFQAAAKQHVAYLSAAADGKGVDRHLFGLKQMIQPGEPIPEIFTDPIFSYSQTWYISSSQVPSEFFQSWGWSQVIDDGFGLAYLINNDWIHVHISCKRGNGLQSDHLKWYLVDSANEMKDVLTKGLLTDAK

SEQ ID NO: 6 - protein, 766 aa, Candida viswanathii
MSTYQFQETLEKLPIPDLNQTCANYLNVLRPLQTEQEHIKTKTAVENFLKNGTGQYLDAALREYAQTRPSYIEQFWYDAYLNYDSPVVLNLNPFFLLEDDPFTNESSSVNPQVKRATSLVMSSLKFIQALKNETLSVDTLKGGKPLCMYQYTKLFGASRIPSEDGCVMQSDPASNHIVVMSKSQLYWFDVLDSKNNLILSEAELNVNFQSIIHDSLRTPSDEIAKSSFGVLTTENRRIWANVRHNLMSTTNNKVNHEVLSIIDSALFVLCFDDIVINDLSELSKNMLCGLSILDNGIQVGTCTNRWYDKLQIIVTKNAKAGINFEHTGVDGHTVLRFVSDIYTDSILSFANSINSNAPSLWNTTTNYKELDGEDLITVPRKLEWELTPDLSLALRFGETRLSDLINQNEFRHLEFKNYGSTQIKKMKFSPDAFVQMAFQATYYALYGKVECTYEPAMTKQFYHGRTEAIRTVSQESNLFVRKFFDSTVSIQKKLEYLTQACTKHSQQTRMSSAGQGVDRHLYALFCIWKRYLHDAEDDDDDASKDQPSSTELSRDDTIIAQTNGDSTDDDDSTTVVGHGANHHHNLKSADLLKTIPEIFADNGWDKLNNTIISTSNCGNPSLRLFGFGPVSANGFGIGYILKDDSISICASSKHRQTQRFLVTLNSYLLEIQNIWKQAQKMEKLKAELAKAVEDAKPKGQKSGEAEGIIEPKPNNLSTLLGGYGYFDMGDEDIKSRGQSPEPPFLHRAGSGFSIREIGKKLRLSEY

SEQ ID NO: 7 - protein, 30 aa, Candida viswanathii
MLSRTTLRVARQQTRLLSTSRILFNSKTDQ

SEQ ID NO: 8 - protein, 25 aa, Candida viswanathii
MSALRSFQRSSNVAKSTLKNSVRTY

SEQ ID NO: 9 - protein, 33 aa, Candida viswanathii
MFNFKLSQQVLKNSTKSIMPILKKPFSTSHAKG

SEQ ID NO: 10 - protein, 795 aa, Artificial Sequence
  Description of Artificial Sequence: Synthetic polypeptide
MLSRTTLRVARQQTRLLSTSRILFNSKTDQSTYQFQETLEKLPIPDLNQTCANYLNVLRPLQTEQEHIKTKTAVENFLKNGTGQYLDAALREYAQTRPSYIEQFWYDAYLNYDSPVVLNLNPFFLLEDDPFTNESSSVNPQVKRATSLVMSSLKFIQALKNETLSVDTLKGGKPLCMYQYTKLFGASRIPSEDGCVMQSDPASNHIVVMSKSQLYWFDVLDSKNNLILSEAELNVNFQSIIHDSLRTPSDEIAKSSFGVLTTENRRIWANVRHNLMSTTNNKVNHEVLSIIDSALFVLCFDDIVINDLSELSKNMLCGLSILDNGIQVGTCTNRWYDKLQIIVTKNAKAGINFEHTGVDGHTVLRFVSDIYTDSILSFANSINSNAPSLWNTTTNYKELDGEDLITVPRKLEWELTPDLSLALRFGETRLSDLINQNEFRHLEFKNYGSTQIKKMKFSPDAFVQMAFQATYYALYGKVECTYEPAMTKQFYHGRTEAIRTVSQESNLFVRKFFDSTVSIQKKLEYLTQACTKHSQQTRMSSAGQGVDRHLYALFCIWKRYLHDAEDDDDDASKDQPSSTELSRDDTIIAQTNGDSTDDDDSTTVVGHGANHHHNLKSADLLKTIPEIFADNGWDKLNNTIISTSNCGNPSLRLFGFGPVSANGFGIGYILKDDSISICASSKHRQTQRFLVTLNSYLLEIQNIWKQAQKMEKLKAELAKAVEDAKPKGQKSGEAEGIIEPKPNNLSTLLGGYGYFDMGDEDIKSRGQSPEPPFLHRAGSGFSIREIGKKLRLSEY

SEQ ID NO: 11 - protein, 790 aa, Artificial Sequence
  Description of Artificial Sequence: Synthetic polypeptide
MSALRSFQRSSNVAKSTLKNSVRTYSTYQFQETLEKLPIPDLNQTCANYLNVLRPLQTEQEHIKTKTAVENFLKNGTGQYLDAALREYAQTRPSYIEQFWYDAYLNYDSPVVLNLNPFFLLEDDPFTNESSSVNPQVKRATSLVMSSLKFIQALKNETLSVDTLKGGKPLCMYQYTKLFGASRIPSEDGCVMQSDPASNHIVVMSKSQLYWFDVLDSKNNLILSEAELNVNFQSIIHDSLRTPSDEIAKSSFGVLTTENRRIWANVRHNLMSTTNNKVNHEVLSIIDSALFVLCFDDIVINDLSELSKNMLCGLSILDNGIQVGTCTNRWYDKLQIIVTKNAKAGINFEHTGVDGHTVLRFVSDIYTDSILSFANSINSNAPSLWNTTTNYKELDGEDLITVPRKLEWELTPDLSLALRFGETRLSDLINQNEFRHLEFKNYGSTQIKKMKFSPDAFVQMAFQATYYALYGKVECTYEPAMTKQFYHGRTEAIRTVSQESNLFVRKFFDSTVSIQKKLEYLTQACTKHSQQTRMSSAGQGVDRHLYALFCIWKRYLHDAEDDDDDASKDQPSSTELSRDDTIIAQTNGDSTDDDDSTTVVGHGANHHHNLKSADLLKTIPEIFADNGWDKLNNTIISTSNCGNPSLRLFGFGPVSANGFGIGYILKDDSISICASSKHRQTQRFLVTLNSYLLEIQNIWKQAQKMEKLKAELAKAVEDAKPKGQKSGEAEGIIEPKPNNLSTLLGGYGYFDMGDEDIKSRGQSPEPPFLHRAGSGFSIREIGKKLRLSEY

SEQ ID NO: 12 - protein, 798 aa, Artificial Sequence
  Description of Artificial Sequence: Synthetic polypeptide
MFNFKLSQQVLKNSTKSIMPILKKPFSTSHAKGSTYQFQETLEKLPIPDLNQTCANYLNVLRPLQTEQEHIKTKTAVENFLKNGTGQYLDAALREYAQTRPSYIEQFWYDAYLNYDSPVVLNLNPFFLLEDDPFTNESSSVNPQVKRATSLVMSSLKFIQALKNETLSVDTLKGGKPLCMYQYTKLFGASRIPSEDGCVMQSDPASNHIVVMSKSQLYWFDVLDSKNNLILSEAELNVNFQSIIHDSLRTPSDEIAKSSFGVLTTENRRIWANVRHNLMSTTNNKVNHEVLSIIDSALFVLCFDDIVINDLSELSKNMLCGLSILDNGIQVGTCTNRWYDKLQIIVTKNAKAGINFEHTGVDGHTVLRFVSDIYTDSILSFANSINSNAPSLWNTTTNYKELDGEDLITVPRKLEWELTPDLSLALRFGETRLSDLINQNEFRHLEFKNYGSTQIKKMKFSPDAFVQMAFQATYYALYGKVECTYEPAMTKQFYHGRTEAIRTVSQESNLFVRKFFDSTVSIQKKLEYLTQACTKHSQQTRMSSAGQGVDRHLYALFCIWKRYLHDAEDDDDDASKDQPSSTELSRDDTIIAQTNGDSTDDDDSTTVVGHGANHHHNLKSADLLKTIPEIFADNGWDKLNNTIISTSNCGNPSLRLFGFGPVSANGFGIGYILKDDSISICASSKHRQTQRFLVTLNSYLLEIQNIWKQAQKMEKLKAELAKAVEDAKPKGQKSGEAEGIIEPKPNNLSTLLGGYGYFDMGDEDIKSRGQSPEPPFLHRAGSGFSIREIGKKLRLSEY

SEQ ID NO: 13 - protein, 769 aa, Artificial Sequence
  Description of Artificial Sequence: Synthetic polypeptide
MSTYQFQETLEKLPIPDLNQTCANYLNVLRPLQTEQEHIKTKTAVENFLKNGTGQYLDAALREYAQTRPSYIEQFWYDAYLNYDSPVVLNLNPFFLLEDDPFTNESSSVNPQVKRATSLVMSSLKFIQALKNETLSVDTLKGGKPLCMYQYTKLFGASRIPSEDGCVMQSDPASNHIVVMSKSQLYWFDVLDSKNNLILSEAELNVNFQSIIHDSLRTPSDEIAKSSFGVLTTENRRIWANVRHNLMSTTNNKVNHEVLSIIDSALFVLCFDDIVINDLSELSKNMLCGLSILDNGIQVGTCTNRWYDKLQIIVTKNAKAGINFEHTGVDGHTVLRFVSDIYTDSILSFANSINSNAPSLWNTTTNYKELDGEDLITVPRKLEWELTPDLSLALRFGETRLSDLINQNEFRHLEFKNYGSTQIKKMKFSPDAFVQMAFQATYYALYGKVECTYEPAMTKQFYHGRTEAIRTVSQESNLFVRKFFDSTVSIQKKLEYLTQACTKHSQQTRMSSAGQGVDRHLYALFCIWKRYLHDAEDDDDDASKDQPSSTELSRDDTIIAQTNGDSTDDDDSTTVVGHGANHHHNLKSADLLKTIPEIFADNGWDKLNNTIISTSNCGNPSLRLFGFGPVSANGFGIGYILKDDSISICASSKHRQTQRFLVTLNSYLLEIQNIWKQAQKMEKLKAELAKAVEDAKPKGQKSGEAEGIIEPKPNNLSTLLGGYGYFDMGDEDIKSRGQSPEPPFLHRAGSGFSIREIGKKLRLSEYPKL

SEQ ID NO: 14 - protein, 284 aa, Candida viswanathii
MDDVDSALADNVKSFAAGGFGGICAVLTGHPFDLVKVRLQTGLYKSSVQCVKETIAKDGLFGLYRGVLPPLLGVTPMFAVSFWGYDVGKKLVSSFTGKSVDKFEIKDISTAGFISAIPTTLVAAPFERVKVMMQIQEGAKSKSMGAVVAEMYRTGGIRSIFKGTVATLARDGPGSALYFATYEWVKKELTAPGEDLSLFAITTAGGFAGIAMWLGVFPIDTIKSTQQSSNVKVSIVQATKNIYAKGGIKAFFPGVGPALARAFPANAATFLGVELARKFLDKVI

SEQ ID NO: 15 - protein, 519 aa, Candida viswanathii
MSAILKQRVRYAPYLKKLRTAEQCVDLFKNGQYLGWSGFTGVGAPKAVPAALVDHVEKNKLQGQMGFHLFVGASAGPEESRWAENNMLLSRSPHQVGKPIAAAINDGRTQFFDKHLSMFPQDLTYGFYTKNKPNGSNLDYTIIEATAITEDGAIIPGPAVGASPEMLSVSDNIIIEVNTKTPSFEGIHDIDLPVNPPFRQPYPHTTADYRIGRTAIPVDPEKVIAIVETTEGDKVPPNTPSDAQSQAIAGHLIEFLENEVKQGRLPENLHPLQSGIGNIANAVVEGLAQSNFKNLTVWTEVLQDSFLDFFESGSLDFATATSIRLTEEGFKKFYENWDVYSKKLCLRSQVVSNSPEIIRRLGVLAFNTPVEVDIYAHANSTNVMGSRMLNGLGGSGDFLRNAKLSVMHTPSARPTKVDPTGVSCIVPMATHVDQTEHDLDVVVTEQGLADLRGLSPKERAQVIINNCAHPDYQAQLQDYFDRAVFYATKKKMLHEPHMLNEAFAMHLNLQENGTMKLNK

SEQ ID NO: 16 - protein, 515 aa, Artificial Sequence
  Description of Artificial Sequence: Synthetic polypeptide
MAPYLKKLRTAEQCVDLFKNGQYLGWSGFTGVGAPKAVPAALVDHVEKNKLQGQMGFHLFVGASAGPEESRWAENNMLLSRSPHQVGKPIAAAINDGRTQFFDKHLSMFPQDLTYGFYTKNKPNGSNLDYTIIEATAITEDGAIIPGPAVGASPEMLSVSDNIIIEVNTKTPSFEGIHDIDLPVNPPFRQPYPHTTADYRIGRTAIPVDPEKVIAIVETTEGDKVPPNTPSDAQSQAIAGHLIEFLENEVKQGRLPENLHPLQSGIGNIANAVVEGLAQSNFKNLTVWTEVLQDSFLDFFESGSLDFATATSIRLTEEGFKKFYENWDVYSKKLCLRSQVVSNSPEIIRRLGVLAFNTPVEVDIYAHANSTNVMGSRMLNGLGGSGDFLRNAKLSVMHTPSARPTKVDPTGVSCIVPMATHVDQTEHDLDVVVTEQGLADLRGLSPKERAQVIINNCAHPDYQAQLQDYFDRAVFYATKKKMLHEPHMLNEAFAMHLNLQENGTMKLNKGRRAKL

SEQ ID NO: 17 - protein, 2274 aa, Artificial Sequence
  Description of Artificial Sequence: Synthetic polypeptide
MRCQVSQPSRFTNLLVHRLPRTLLNYPVVNTLFIPRRHYSLNFSFKNLLKKMTDLSPSPTDSLNYTQLHSSLPSHFLGGNSVLTAEPSAVTDFVKTHQGHTVITKVLIANNGIGAVKEIRSVRKWAYETFGDERAIQFVAMATPEDMEANAEYIRMADQFVEVPGGTNNNNYANVDLIVEIAERTDVHAVWAGWGHASENPLLPERLAASPKKIVFIGPPGSAMRSLGDKISSTIVAQHAKVPCIPWSGTGVEEVHVDPETKLVSVDDHVYAKGCCTSPEDGLEKAKRIGFPVMVKASEGGGGKGIRKVDHEKDFISLYNQAANEIPGSPIFIMKLAGDARHLEVQLFADQYGTNISLFGRDCSVQRRHQKIIEEAPVTIANKDTFVEMEKAAVRLGKLVGYVSAGTVEYLYSYAEDKFYFLELNPRLQVEHPTTEMVSGVNLPAAQLQIAMGLPMHRIRDIRLLYGVDPHSATEIDFEFKSPNSLITQRKPAPKGHCTACRITSEDPGEGFKPSGGTLHELNFRSSSNVWGYFSVANQSSIHSFADSQFGHIFAFGENRQASRKHMIVALKELSIRGDFRTTVEYLIKLLETPDFADNTITTGWLDELITKKLTAERPDPIVAVVCGAVTKAHIQAEEDKKEYIESLEKGQVPNKSLLKTIFPVEFIYEGERYKFTATKSSEDKYTLFLNGSRCVIGARSLSDGGLLCALDGKSHSVYWKEEAAATRLSVDGKTCLLEVENDPTQLRTPSPGKLVKYLVESGEHVDAGQSYAEVEVMKMCMPLIAQENGTVQLLKQPGSTLNAGDILAILALDDPSKVKHAKPYEGTLPEMGDPTVTGSKPAHLFQHYDTILKNILAGYDNQVILNSTLKNMMEILKNKELPYSEWRLQISALHSRIPPKLDEALTSLIERTESRGAEFPARQILKLVNKTLGEPGNELLGDVVAPLVSIANRYQNGLVEHEYDYFASLVNEYCNVEHFFSGENVREEDVILRLRDENKSDLKKVISICLSHSRVSAKNNLILAILEAYEPLLQSNSSTAVAIRDSLKKIVQLDSRACAKVGLKARELLIQCSLPSIKERSDQLEHILRSAVVETSYGEVFAKHREPKLEIIQEVVESKHVVFDVLSQFLVHQDCWVAIAAAEVYVRRSYRAYDLGKIDYHIHDRLPIVEWKFKLAQIAGSRYNAVQSASVGDDSTTMKHAASVSDLSFVVDSKSESTSRTGVLVPARHLDDVDEILSAALEYFQPSDALSFQAKGERPELLNVLNIVITDIDGYSDEDECLKRIHEILNEYEDDLVFAGVRRVTFVFAHQVGSYPKYYTFTGPVYEENKVIRHIEPALAFQLELGRLANFDIKPIFTNNRNIHVYEAIGKNAPSDKRFFTRGIIRGGVLKDEISLTEYLIAESNRLISDILDTLEVIDTSNSDLNHIFINFSNVFNVQPADVEAAFASFLERFGRRLWRLRVTGAEIRIVCTDPQGNSFPLRAIINNVSGYVVKSELYLEVKNPKGDWVFKSIGHPGSMHLQPISTPYPVKESLQPKRYRAHNMGTTFVYDFPELFRQATISQWKKHGKKAPKDVFTSLELITDENDALVAVERDPGANKIGMVGFKVTAKTPEYPRGRSFIIVANDITHKIGSFGPDEDEYFNKCTDLARKLGVPRIYLSANSGARIGVAEELIPLYQVAWNEEGNPDKGFRYLYLNPDAKEALEKDGKGDTIVTERIVEDGQERHVIKAIIGAENGLGVECLKGSGLIAGATSRAYRDIFTITLVTCRSVGIGAYLVRLGQRAIQIEGQPIILTGAPAINKLLGREVYSSNLQLGGTQIMYNNGVSHLTASDDLAGVEKIMEWLSYVPAKRGMPVPILESEDTWDRDIDYYPPKQEAFDIRWMIEGKQVEGEEFESGLFDKGSFQETLSGWAKGVVVGRARLGGIPIGVIGVETRTIENMIPADPANPSSTEALIQEAGQVWYPNSAFKTAQAINDFNNGEQLPLMILANWRGFSGGQRDMYNEVLKYGSFIVDALVDFKQPIFTYIPPNGELRGGSWVVVDPTINSDMMEMYADVDSRAGVLEPEGMVGIKYRRDKLLATMQRLDPTYAQLKEKLNDSSLSPEEHAQVSTKIVKREKALLPIYAQISVQFADLHDRSGRMMAKGVIRKEIKWVDARRFFFWRLRRRLNEEYVLKLIGEQVKNANKLEKVARLKSWMPTVDYDDDQAVSTWIEENHAKLQKRVEELRQEKNKSDIVKLLQEDPSNAASVMRDFVDRLSDEEKEKFLKSLN

SEQ ID NO: 18 - protein, 2223 aa, Artificial Sequence
  Description of Artificial Sequence: Synthetic polypeptide
MTDLSPSPTDSLNYTQLHSSLPSHFLGGNSVLTAEPSAVTDFVKTHQGHTVITKVLIANNGIGAVKEIRSVRKWAYETFGDERAIQFVAMATPEDMEANAEYIRMADQFVEVPGGTNNNNYANVDLIVEIAERTDVHAVWAGWGHASENPLLPERLAASPKKIVFIGPPGSAMRSLGDKISSTIVAQHAKVPCIPWSGTGVEEVHVDPETKLVSVDDHVYAKGCCTSPEDGLEKAKRIGFPVMVKASEGGGGKGIRKVDHEKDFISLYNQAANEIPGSPIFIMKLAGDARHLEVQLFADQYGTNISLFGRDCSVQRRHQKIIEEAPVTIANKDTFVEMEKAAVRLGKLVGYVSAGTVEYLYSYAEDKFYFLELNPRLQVEHPTTEMVSGVNLPAAQLQIAMGLPMHRIRDIRLLYGVDPHSATEIDFEFKSPNSLITQRKPAPKGHCTACRITSEDPGEGFKPSGGTLHELNFRSSSNVWGYFSVANQSSIHSFADSQFGHIFAFGENRQASRKHMIVALKELSIRGDFRTTVEYLIKLLETPDFADNTITTGWLDELITKKLTAERPDPIVAVVCGAVTKAHIQAEEDKKEYIESLEKGQVPNKSLLKTIFPVEFIYEGERYKFTATKSSEDKYTLFLNGSRCVIGARSLSDGGLLCALDGKSHSVYWKEEAAATRLSVDGKTCLLEVENDPTQLRTPSPGKLVKYLVESGEHVDAGQSYAEVEVMKMCMPLIAQENGTVQLLKQPGSTLNAGDILAILALDDPSKVKHAKPYEGTLPEMGDPTVTGSKPAHLFQHYDTILKNILAGYDNQVILNSTLKNMMEILKNKELPYSEWRLQISALHSRIPPKLDEALTSLIERTESRGAEFPARQILKLVNKTLGEPGNELLGDVVAPLVSIANRYQNGLVEHEYDYFASLVNEYCNVEHFFSGENVREEDVILRLRDENKSDLKKVISICLSHSRVSAKNNLILAILEAYEPLLQSNSSTAVAIRDSLKKIVQLDSRACAKVGLKARELLIQCSLPSIKERSDQLEHILRSAVVETSYGEVFAKHREPKLEIIQEVVESKHVVFDVLSQFLVHQDCWVAIAAAEVYVRRSYRAYDLGKIDYHIHDRLPIVEWKFKLAQIAGSRYNAVQSASVGDDSTTMKHAASVSDLSFVVDSKSESTSRTGVLVPARHLDDVDEILSAALEYFQPSDALSFQAKGERPELLNVLNIVITDIDGYSDEDECLKRIHEILNEYEDDLVFAGVRRVTFVFAHQVGSYPKYYTFTGPVYEENKVIRHIEPALAFQLELGRLANFDIKPIFTNNRNIHVYEAIGKNAPSDKRFFTRGIIRGGVLKDEISLTEYLIAESNRLISDILDTLEVIDTSNSDLNHIFINFSNVFNVQPADVEAAFASFLERFGRRLWRLRVTGAEIRIVCTDPQGNSFPLRAIINNVSGYVVKSELYLEVKNPKGDWVFKSIGHPGSMHLQPISTPYPVKESLQPKRYRAHNMGTTFVYDFPELFRQATISQWKKHGKKAPKDVFTSLELITDENDALVAVERDPGANKIGMVGFKVTAKTPEYPRGRSFIIVANDITHKIGSFGPDEDEYFNKCTDLARKLGVPRIYLSANSGARIGVAEELIPLYQVAWNEEGNPDKGFRYLYLNPDAKEALEKDGKGDTIVTERIVEDGQERHVIKAIIGAENGLGVECLKGSGLIAGATSRAYRDIFTITLVTCRSVGIGAYLVRLGQRAIQIEGQPIILTGAPAINKLLGREVYSSNLQLGGTQIMYNNGVSHLTASDDLAGVEKIMEWLSYVPAKRGMPVPILESEDTWDRDIDYYPPKQEAFDIRWMIEGKQVEGEEFESGLFDKGSFQETLSGWAKGVVVGRARLGGIPIGVIGVETRTIENMIPADPANPSSTEALIQEAGQVWYPNSAFKTAQAINDFNNGEQLPLMILANWRGFSGGQRDMYNEVLKYGSFIVDALVDFKQPIFTYIPPNGELRGGSWVVVDPTINSDMMEMYADVDSRAGVLEPEGMVGIKYRRDKLLATMQRLDPTYAQLKEKLNDSSLSPEEHAQVSTKIVKREKALLPIYAQISVQFADLHDRSGRMMAKGVIRKEIKWVDARRFFFWRLRRRLNEEYVLKLIGEQVKNANKLEKVARLKSWMPTVDYDDDQAVSTWIEENHAKLQKRVEELRQEKNKSDIVKLLQEDPSNAASVMRDFVDRLSDEEKEKFLKSLN

SEQ ID NO: 19 - protein, 2223 aa, Artificial Sequence
  Description of Artificial Sequence: Synthetic polypeptide
MTDLSPSPTDSLNYTQLHSSLPSHFLGGNSVLTAEPSAVTDFVKTHQGHTVITKVLIANNGIGAVKEIRSVRKWAYETFGDERAIQFVAMATPEDMEANAEYIRMADQFVEVPGGTNNNNYANVDLIVEIAERTDVHAVWAGWGHASENPLLPERLAASPKKIVFIGPPGSAMRSLGDKISSTIVAQHAKVPCIPWSGTGVEEVHVDPETKLVSVDDHVYAKGCCTSPEDGLEKAKRIGFPVMVKASEGGGGKGIRKVDHEKDFISLYNQAANEIPGSPIFIMKLAGDARHLEVQLFADQYGTNISLFGRDCSVQRRHQKIIEEAPVTIANKDTFVEMEKAAVRLGKLVGYVSAGTVEYLYSYAEDKFYFLELNPRLQVEHPTTEMVSGVNLPAAQLQIAMGLPMHRIRDIRLLYGVDPHSATEIDFEFKSPNSLITQRKPAPKGHCTACRITSEDPGEGFKPSGGTLHELNFRSSSNVWGYFSVANQSSIHSFADSQFGHIFAFGENRQASRKHMIVALKELSIRGDFRTTVEYLIKLLETPDFADNTITTGWLDELITKKLTAERPDPIVAVVCGAVTKAHIQAEEDKKEYIESLEKGQVPNKSLLKTIFPVEFIYEGERYKFTATKSSEDKYTLFLNGSRCVIGARSLSDGGLLCALDGKSHSVYWKEEAAATRLSVDGKTCLLEVENDPTQLRTPSPGKLVKYLVESGEHVDAGQSYAEVEVMKMCMPLIAQENGTVQLLKQPGSTLNAGDILAILALDDPSKVKHAKPYEGTLPEMGDPTVTGSKPAHLFQHYDTILKNILAGYDNQVILNSTLKNMMEILKNKELPYSEWRLQISALHSRIPPKLDEALTSLIERTESRGAEFPARQILKLVNKTLGEPGNELLGDVVAPLVSIANRYQNGLVEHEYDYFASLVNEYCNVEHFFSGENVREEDVILRLRDENKSDLKKVISICLSHSRVSAKNNLILAILEAYEPLLQSNSSTAVAIRDSLKKIVQLDSRACAKVGLKARELLIQCSLPSIKERSDQLEHILRSAVVETSYGEVFAKHREPKLEIIQEVVESKHVVFDVLSQFLVHQDCWVAIAAAEVYVRRSYRAYDLGKIDYHIHDRLPIVEWKFKLAQIAGSRYNAVQSASVGDDSTTMKHAAAVSDLSFVVDSKSESTSRTGVLVPARHLDDVDEILSAALEYFQPSDALSFQAKGERPELLNVLNIVITDIDGYSDEDECLKRIHEILNEYEDDLVFAGVRRVTFVFAHQVGSYPKYYTFTGPVYEENKVIRHIEPALAFQLELGRLANFDIKPIFTNNRNIHVYEAIGKNAPSDKRFFTRGIIRGGVLKDEISLTEYLIAESNRLISDILDTLEVIDTSNSDLNHIFINFSNVFNVQPADVEAAFASFLERFGRRLWRLRVTGAEIRIVCTDPQGNSFPLRAIINNVSGYVVKSELYLEVKNPKGDWVFKSIGHPGSMHLQPISTPYPVKESLQPKRYRAHNMGTTFVYDFPELFRQATISQWKKHGKKAPKDVFTSLELITDENDALVAVERDPGANKIGMVGFKVTAKTPEYPRGRSFIIVANDITHKIGSFGPDEDEYFNKCTDLARKLGVPRIYLSANSGARIGVAEELIPLYQVAWNEEGNPDKGFRYLYLNPDAKEALEKDGKGDTIVTERIVEDGQERHVIKAIIGAENGLGVECLKGSGLIAGATSRAYRDIFTITLVTCRSVGIGAYLVRLGQRAIQIEGQPIILTGAPAINKLLGREVYSSNLQLGGTQIMYNNGVSHLTASDDLAGVEKIMEWLSYVPAKRGMPVPILESEDTWDRDIDYYPPKQEAFDIRWMIEGKQVEGEEFESGLFDKGSFQETLSGWAKGVVVGRARLGGIPIGVIGVETRTIENMIPADPANPSSTEALIQEAGQVWYPNSAFKTAQAINDFNNGEQLPLMILANWRGFSGGQRDMYNEVLKYGSFIVDALVDFKQPIFTYIPPNGELRGGSWVVVDPTINSDMMEMYADVDSRAGVLEPEGMVGIKYRRDKLLATMQRLDPTYAQLKEKLNDSSLSPEEHAQVSTKIVKREKALLPIYAQISVQFADLHDRSGRMMAKGVIRKEIKWVDARRFFFWRLRRRLNEEYVLKLIGEQVKNANKLEKVARLKSWMPTVDYDDDQAVSTWIEENHAKLQKRVEELRQEKNKSDIVKLLQEDPSNAASVMRDFVDRLSDEEKEKFLKSLN

SEQ ID NO: 20 - protein, 675 aa, Candida viswanathii
MPESTQQSHISLDHEKMQQPPTGFTERSTAKPNLADFDTYKKLYKQSVENPNEFFTEQANKNLDWFKPFDLARFPVDPKDDFKNGDLPAWFINGQLNASYNAVDRWAIKNPDKPAIIYEGDEPDSGRIITYGELLKEVSKLAQTLTKLGVKKGDSVAVYLPMIPEAIVTLLAIVRIGAVHSVVFAGFSSASLRDRILDADSRIVITADESKRGGKTIETKKIVDDALKECPKVRNVIVFKRTGNSHVPFSAGRDLWWHEEMAKYGPYFPPVPVNSEDPLFLLYTSGSTGKPKGVQHNTAGYLLGAILTTKYTFDVHEEDVLFTAGDVGWITGHTYCVYGPLLCGATTVVFEGTPAYPNYSRYWEIVDQYKVNQFYVAPTALRLLKRAGTKYVEKYDLSSLRVLGSVGEPIAAEVWHWYNDNIGRGKAHIVDTYWQTESGSHLLTPLAGVTPTKPGSASLPFFGVVPKILDPTTGEELEGNDVEGVLAIKSAWPSITRGIYNDYNRFIETYLAPYHDHYFSGDGAARDNDGFYWILGRVDDVVNVSGHRLSTAEIEAALIEHPLVAESAVVGYADDLTGQAVAAYVSLKKDKVIGDDMEAVKKELILTVRKEIGPFAAPKLILLVDDLPKTRSGKIMRRILRKVLAGEEDQLGDISTLSNPGVVQQIIEIVHACKK

SEQ ID NO: 21 - protein, 671 aa, Candida viswanathii
MTTDSNTHKVVHEANGVKLRQTPKEFFQRQPNKGHIQDTEEYKKLYEQSIKDPQGFFGPLAKELLSWDSDFHTVKSGTLKNGDAAWFLGGKLNASYNCVARHALANPNKPAIIYEADEERDSYILTYGDLLREVSKVAGVLHSWGIRKGDTVAVYLPMNAQALIAMLAIARLGAAHSVIFAGFSSGSIKDRVNDASCKALITCDEGRRGGRTTNIKKLCDEALKQCPTVKHVLVHRRTGNPEIKLTEGRDYYWDEETAKFSGYFPPVPVDSEDPLFLLYTSGSTGTPKGVVHTTAGYLLGAALSTKYIFDVHPEDVFFTAGDVGWITGHTYALYGPLLLGVPSVVFEGTPAYPDYGRFWQIVEKHKATHFYVAPTALRLLRKAGEQEVGKYDLSSLRTLGSVGEPISPDIWEWYNEFVGKDQCHISDTYWQTESGSHLIAPLAGAIANKPGSASYPFFGIEAALIDPVTGVEIKGNDVEGVLVVKDHWPSMARTVFNNHVKYMDTYMNPYPGYYFTGDGAARDNDGYYWIRGRVDDVVNVSGHRLSTAEIESALIEDPRVGESAVVGINDDLTGQAVIAYVALKSGDVADEDALRKELILLVRKEIGPFAAPKSVILVQDLPKTRSGKIMRRILRKVSSNEADQLGDITTLQNPGSVEGMISAFGAQFGRK

SEQ ID NO: 22 - protein, 383 aa, Candida viswanathii
MLTLTSGPNPLPDFEEALRVIKVDDTHYVGAHSLRLPVKGGRGVYGGHMIAQSLLVGIESTRDDKTNKVFIPDSYHSYFIGAGNAKIPMNYTVEKLYDDENVSKRFIIAEQKGRHRLTCLVTLRRPGTKPFHDSDNLDISIPVPKIQLKHPDPDKLHQVQHTDFIRNAFGKELMDYRECPEENELYAAERWLTVFTGIRNQPKPGASLETVVEELPDAQGQMHTVEKSILRPKDSQSFKDPIYNFVGLADLSDSAFLTTMARILHIPWAPSIEIDDTYDPARDATYIMRSTLNAAHIFHYNAMSLDHHIYFHNEDYTSDDGSGFDICKDWLAFTYQMKRLSNNRTLVRGFLFNEKHKCIATVVQEGLTIMQNGVGRTADKSRL

SEQ ID NO: 23 - protein, 326 aa, Candida viswanathii
MIENISGNGNYPQNHEVDLEKEFGVEKIGINLYRGKSPIPKPDRRSRGAYGGYLAGQALLVAMKSTPPEYRPHSFHSYFIKAVNDKETLEWRVEETSNGRNYANRSLQAFQAGNLVYTANVSLTKKNSAKKAEEATGVKPFEFQGKPHEWFEKHKRDDLPLATPSSSLLIYHKFFPEVVSLEASKEEESKPAADRELSWYFKWGINNEEGHHQPLVNLNSDYQYVGMAALTDAVYLNRLLRILRVEDADHTQLVHYFSVSLDHTMYFHDDDFDVTKWMGFTFKVTRFSHNRALCQGEVYNDKGVHVCTIVQEGLMMLNGLEQGAKL

SEQ ID NO: 24 - protein, 326 aa, Candida viswanathii
MIESISENGNYPQNHEVDLEKEFGVEKIGINLYRGKSPIPKPDRRSRGAYGGYLAGQALLVAMKSTPPDYRPHSFHSYFIKAVNDKVTLEWRVEETSNGRNYANRALQAFQAGDLVYTANVSLTKKNSAKKTEEATGVKPFEFQGKPHEWFDKHKIDDLPLATPSSSLLIYHKFFPEVVSLEASKEEESKPAADRELSWYFKWGINNEEGHHQPLVNLNSDYQYVGMAALTDAVYLNRLLRILRVQDADHTQLVHYFSVSLDHTMYFHDDDFDVTKWMGFTFKVTRFSHNRALCQGEVYNDKGVHVCTIVQEGLMMLNGLEEGAKL

SEQ ID NO: 25 - protein, 279 aa, Candida viswanathii
MSHPTPEEVYGVTKVAENKYVGNRPLNKPTPKTRGVYGGNFCAQAILVAIESAPEGFTPHSIHSNFIRGGDPEVPVEWEVEVISNGKSFANRIVKGVQHGIVVYVATVSLTNKNSTTRNESFTYDTPPDETVKTYGNAELDTYYQGWLYLEVKNYPKQLHSHQISYSVKWGPENDAWKDASQTYQFVGLAAISDVLDLGQILRNLDIHLSTPKFNVSLDHSVYFHGADFDVTRWSTTTIRMTKLAHGRALIEGEMYSDQGRHIASIVQERLYIAESPKL

SEQ ID NO: 26 - protein, 298 aa, Candida viswanathii
MTSIAPATDIPAVDISTIYDVKQIDANRYRGVRPLQKQAREFRGVFGGNLVAQSVVVALRSVPAGFHPNSVHAYYVRAVTDETPIEWEVEETTTGRTFANRSIRGLQNKKVVFTASISLTRKNSNAEVIQKTGHPSLQFQRDTEPYYEQMRARPGECKVLYINANTHLTVRQFPEVSSRDVFSFLVRFGNDGRERIVGMTPEYQYAALAALSDWVRLRFYFDNMGVDVQTSFDVSLDHSIYFHDDGFDATEYLVFSVKVSRISHSRVLYDGQIFNDRGAHVASIRQERLYVVSNKPKF

SEQ ID NO: 27 - protein, 353 aa, Candida viswanathii
MPTFNYKDGETIDVQKEFGVVETAPNKYVGVKPLVKPMPHVKGVFGGNLAGQALLVAMKSVGPDFSPHSLHSYFIRAGSDQTPVEWTVQAISDGNSFCNRFIKGVQNGQVIYIANVSLTKRNSAADAMKKYEEYHAQIRQKGKDGDADEEDEDDDDEDDNAPAKPFGFQTPSHKWIKDRDLDKLPVSDMESNLLLYYKLPPEFVSLKSSTEEESLPVSERRMGALAKWGIENEQGFNQPLTNLDKSFQYVGLANITDGLYLGTLNRILRIDDLTLDERATNYFSVSLDHVIYFHDDDFDVTKWMGFTFRCSRYSHNRVIFEGEIYSDKGVQVASIIQEGLVRFKDGYLKNAKL

SEQ ID NO: 28 - protein, 349 aa, Candida viswanathii
MSTTGIYNAKPAAAILETKTKVKLVYTEGPKLVYEGLHPVETIKETVRGTYGGDFIAQGVNAAWESIGNRMDFQPHSLHAYYIKSGSQESVLRWEVFKVSDSRSFANRMLTAYQTHTNQLVFTMQISFTKDNNEEIKRAEYEKLLASGGKIRSIPFVIKKAPNEKYFKLRDRINELHYSEYTNGIIAMASPLDFHEYATEMNYDTLGNKEYGTFMKILDNYSLGKDYSKQSFLGLSFLSDGVWVFCFTRALGLPLGSYEKEFFRVSLDHTVYFHDANFDSSEWLFLDFRFVNMKNNRFLTVLNYYTLQGKLIATVLQEVYTSLHQGIIDKSQEIAVKSGNKKQVTTPKL

SEQ ID NO: 29 - protein, 351 aa, Candida viswanathii
MDKLQAEVYEAEPPVAKLEAKTAAKLISSDGAKLTYEGVYPVELVRKGLRGTYGGDFIAQGINVAWESIGNKTDFQPHSLHAYFVKAGSDSSVLRWEVLKVSDSRNFANRLMLAYQTHTNELVFTMQISFTKDNNEEIKRAEYKQLLQSGGKIRSIPFAIKKPPNEKYFKLKDKVDDLPYFEHTNGNMATAIPPDFLEYATEMNHDTVGNKEFGIFMKVLDDYSLGKNYERQSFLGLAFLSDAVWLSSFTPALGLPLGTLERKFFRVSLDHTMYFHDANFDSSEWIFVDFRFVNLNNNRLLGVVNFYTLQGKLVATVIQEAYMFLHQAIIDKSQEIAEKSGHKKQVITPKL

SEQ ID NO: 30 - protein, 351 aa, Candida viswanathii
MDKLQAEVYDAEPPVAKLEAKTAAKLISADGAKLIYEGVYPVELVRKGLRGTYGGDFIAQGINVAWESIGNKTDFQPHSLHAYFVKAGSDQSVLRWEVLKVSDSRSFANRLMLAYQTHTNQLVFTMQISFTKDNNEEIKRAEYKQLLESGGKIRSIPFAIKKPPNEKYFKLKDKVDDLPYFEHTNGNMATAIPPDFLEYATEMNHDTVGNKEFGIFMKVLDDYSLDKNYERQSFLGLAFLSDAVWLSSFTPALGLPLGTFERKFFRVSLDHTMYFHDANFDSSEWIFVDFRFVNLNNNRLLGVVNFYTLQGKLVATVIQEAYMFLHQGIIDQSQEIAEKSGHKKQVITPKL

SEQ ID NO: 31 - protein, 351 aa, Candida viswanathii
MERLQAEVYDAKPTVAKLETKTTVKLVAQDGKRLVYEAIYPVEHIKEGIPGAYGGDTLAQGMNAAWDSLGDKKDFQPHSVHSYFVKPATNKSILRWEVIKVSDGRSFANRFVSGYQTHNNALVFTMQISFTKYNDEVVKIAEYNKLLESGGKIRSIPFVIKKAPNEKYFKFKDNLGDLRYIEHTNGNIATAMSEDLFEYATEMNHDTLGNQEFGIFMKVLDNYSLGSDYTKQSYLGLAFLSDAIWMSVCSRALGLPFGSYHRQFFGVSMDHSMYFHDANFDSTEWIFLDFRFVNLKNDRLLGVANFYTLEGKLISTLIQEAYLFLHPGIIAKSQEIAVKSGNKRQVKMPKL

SEQ ID NO: 32 - protein, 276 aa, Artificial Sequence
  Description of Artificial Sequence: Synthetic polypeptide
MSHPTPEEVYGVTKVAENKYVGNRPLNKPTPKTRGVYGGNFCAQAILVAIESAPEGFTPHSIHSNFIRGGDPEVPVEWEVEVISNGKSFANRIVKGVQHGIVVYVATVSLTNKNSTTRNESFTYDTPPDETVKTYGNAELDTYYQGWLYLEVKNYPKQLHSHQISYSVKWGPENDAWKDASQTYQFVGLAAISDVLDLGQILRNLDIHLSTPKFNVSLDHSVYFHGADFDVTRWSTTTIRMTKLAHGRALIEGEMYSDQGRHIASIVQERLYIAES

SEQ ID NO: 33 - protein, 231 aa, Candida viswanathii
MVADSLVYHPTVSKLVKFLDTTPKREKVFRLLSYLSRFLGYYAYRKGYSKETIALFANLKGNFTFIRKAMRFLKPINHLQLASKAYDNKLLDPVLQITTIIRNLAYAGYLTIDGVIFFKLLGLIDAKKFPNLATYASRFWLIGLIAGLINSLRIIYSLKDYEHQEGDKEKETDAKAIHTKLYAAKRKLVWDLLDTFIALNSLDILHFTEGDVGFAGTITSLLGLEDLWKAT

SEQ ID NO: 34 - protein, 679 aa, Candida viswanathii
MALDKLDLYVIITLVVAVAAYFAKNQFLDQPQDTGFLNTDSGSNSRDVLSTLKKNNKNTLLLFGSQTGTAEDYANKLSRELHSRFGLKTMVADFADYDWDNFGDITEDILVFFIVATYGEGEPTDNADEFHTWLTEEADTLSTLRYTVFGLGNSTYEFFNAIGRKFDRLLSEKGGDRFAEYAEGDDGTGTLDEDFMAWKDNVFDALKNDLNFEEKELKYEPNVKLTERDDLSAADSQVSLGEPNKKYINSEGIDLTKGPFDHTHPYLARITETRELFSSKERHCIHVEFDISESNLKYTTGDHLAIWPSNSDENIKQFAKCFGLEDKLDTVIELKALDSTYTIPFPTPITYGAVIRHHLEISGPVSRQFFLSIAGFAPDEETKKTFTRLGGDKQEFATKVTRRKFNIADALLYSSNNTPWSDVPFEFLIENIQHLTPRYYSISSSSLSEKQLINVTAVVEAEEEADGRPVTGVVTNLLKNIEIAQNKTGEKPLVHYDLSGPRGKFNKFKLPVHVRRSNFKLPKNSTTPVILIGPGTGVAPLRGFVRERVQQVKNGVNVGKTLLFYGCRNSNEDFLYKQEWAEYASVLGENFEMFNAFSRQDPSKKVYVQDKILENSQLVHELLTEGAIIYVCGDASRMARDVQTTISKIVAKSREISEDKAAELVKSWKVQNRYQEDVW

SEQ ID NO: 35 - protein, 696 aa, Candida viswanathii
MGAPLTVAVGEAKPGETAPRRKAAQKMASVERPTDSKATTLPDFIEECFARNGTRDAMAWRDLVEIHVETKQVTKIIDGEQKKVDKDWIYYEMGPYNYISYPKLLTLVKNYSKGLLELGLAPDQESKLMIFASTSHKWMQTFLASSFQGIPVVTAYDTLGESGLTHSLVQTESDAVFTDNQLLSSLIRPLEKATSVKYVIHGEKIDPNDKRQGGKIYQDAEKAKEKILQIRPDIKFISFDEVVALGEQSSKELHFPKPEDPICIMYTSGSTGAPKGVVITNANIVAAVGGISTNATRDLVRTVDRVIAFLPLAHIFELAFELVTFWWGAPLGYANVKTLTEASCRNCQPDLIEFKPTIMVGVAAVWESVRKGVLSKLKQASPIQQKIFWAAFNAKSTLNRYGLPGGGLFDAVFKKVKAATGGQLRYVLNGGSPISVDAQVFISTLLAPMLLGYGLTETCANTTIVEHTRFQIGTLGTLVGSVTAKLVDVADAGYYAKNNQGEIWLKGGPVVKEYYKNEEETKAAFTEDGWFKTGDIGEWTADGGLNIIDRKKNLVKTLNGEYIALEKLESIYRSNHLILNLCVYADQTKVKPIAIVLPIEANLKSMLKDEKIIPDADSQELSSLVHNKKVAQAVLRHLLQTGKQQGLKGIELLQNVVLLDDEWTPQNGFVTSAQKLQRKKILESCKKEVEEAYKSS

SEQ ID NO: 36 - protein, 662 aa, Candida viswanathii
MPTELQKERELTKFNPKELNYFLEGSQERSEIISNMVEQMQKDPILKVDASYYNLTKDQQREVTAKKIARLSRYFEHEYPDQQAQRLSILGVFDPQVFTRIGVNLGLFVSCVRGNGTNSQFFYWTINKGIDKLRGIYGCFGMTELAHGSNVQGIETTATFDEDTDEFVINTPHIGATKWWIGGAAHSATHCSVYARLKVKGKDYGVKTFVVPLRDSNHDLEPGVTVGDIGAKMGRDGIDNGWIQFSNVRIPRFFMLQKYCKVSRLGEVTMPPSEQLSYSALIGGRVTMMMDSYRMTSRFITIALRYAIHRRQFKKKDTDTIETKLIDYPLHQKRLFPFLAAAYLFSQGALYLEQTMNATNDKLDEAVSAGEKEAIDAAIVESKKLFVASGCLKSTCTWLTAEAIDEARQACGGHGYSSYNGFGKAYSDWVVQCTWEGDNNILAMNVAKPMVRDLLKEPEQKGLVLSSVADLDDPAKLVKAFDHALSGLARDIGAVAEDKGFDITGPSLVLVSKLNAHRFLIDGFFKRITPEWSEVLRPLGFLYADWILTNFGATFLQYGIITPDVSRKISSEHFPALCAKVRPNVVGLTDGFNLTDMMTNAAIGRYDGNVYEHYFETVKALNPPENTKAPYSKALEDMLNRPDLEVRERGEKSEEAAEILSS

SEQ ID NO: 37 - protein, 662 aa, Artificial Sequence
  Description of Artificial Sequence: Synthetic polypeptide
MPTELQKERELTKFNPKELNYFLEGSQERSEIISNMVEQMQKDPILKVDASYYNLTKDQQREVTAKKIARLSRYFEHEYPDQQAQRLSILGVFDPQVGTRIGVNLGLFVSCVRGNGTNSQFFYWTINKGIDKLRGIYGCFGMTELAHGSNVQGIETTATFDEDTDEFVINTPHIGATKWWIGGAAHSATHCSVYARLKVKGKDYGVKTFVVPLRDSNHDLEPGVTVGDIGAKMGRDGIDNGWIQFSNVRIPRFFMLQKYCKVSRLGEVTMPPSEQLSYSALIGGRVTMMMDSYRMTSRFITIALRYAIHRRQFKKKDTDTIETKLIDYPLHQKRLFPFLAAAYLFSQGALYLEQTMNATNDKLDEAVSAGEKEAIDAAIVESKKLFVASGCLKSTCTWLTAEAIDEARQACGGHGYSSYNGFGKAYSDFVVQCTWEGDNNILAMNVAKPMVRDLLKEPEQKGLVLSSVADLDDPAKLVKAFDHALSGLARDIGAVAEDKGFDITGPSLVLVSKLNAHRFLIDGFFKRITPEWSEVLRPLGFLYADWILTNFGATFLQYGIITPDVSRKISSEHFPALCAKVRPNVVGLTDGFNLTDMMTNAAIGRYDGNVYEHYFETVKALNPPENTKAPYSKALEDMLNRPDLEVRERGEKSEEAAEILSS

SEQ ID NO: 38 - protein, 662 aa, Artificial Sequence; identical to SEQ ID NO: 36
  Description of Artificial Sequence: Synthetic polypeptide

SEQ ID NO: 39 - protein, 709 aa, Candida viswanathii
MTFTKKNVSVSQGPDPRSSIQKERDSSKWNPQQMNYFLEGSVERSELMKALAQQMERDPILFTDGSYYDLTKDQQRELTAVKINRIARYREQESIDTFNKRLSLIGIFDPQVGTRIGVNLGLFLSCIRGNGTTSQLNYWANEKETADVKGIYGCFGMTELAHGSNVAGLETTATFDKESDEFVINTPHIGATKWWIGGAAHSATHCSVYARLIVDGQDYGVKTFVVPLRDSNHDLMPGVTVGDIGAKMGRDGIDNGWIQFSNVRIPRFFMLQKFCKVSAEGEVTLPPLEQLSYSALLGGRVMMVLDSYRMLARMSTIALRYAIGRRQFKGDNVDPKDPNALETQLIDYPLHQKRLFPYLAAAYVISAGALKVEDTIHNTLAELDAAVEKNDTKAIFKSIDDMKSLFVDSGSLKSTATWLGAEAIDQCRQACGGHGYSSYNGFGKAYNDWVVQCTWEGDNNVLAMSVGKPIVKQVISIEDAGKTVRGSTAFLNQLKDYTGSNSSKVVLNTVADLDDIKTVIKAIEVAIIRLSQEAASIVKKESFDYVGAELVQLSKLKAHHYLLTEYIRRIDTFDQKDLVPYLITLGKLYAATIVLDRFAGVFLTFNVASTEAITALASVQIPKLCAEVRPNVVAYTDSFQQSDMIVNSAIGRYDGDIYENYFDLVKLQNPPSKTKAPYSDALEAMLNRPTLDERERFEKSDETAAILSK

SEQ ID NO: 40 - protein, 735 aa, Candida viswanathii
MVNISKLTGYNKQDIRNVVLLLQEFVKTYKDNKIKLNYSSRPVILFLSTLVATAGIGVFFTLRSIVTKYNEYLLNKRLRRPSLIRQSSNILKNGSREIFIQKGNGKVTRIIIPKANNDQYAADKYLYKDFARNEQILQQQKGRLFNSRFLNQLTIIWKILIPKFYCQNTSLLLSQCFFLIFRTWLSLLIAKLDGQIVKNLIAADGRKFARDLIYFLLIAFPASYTNAAIKYLELRLALGFRTNLTRYIHDMYLDKTMSYYKVGLNGADIQNIDQYITEDVTKFCMSLCSLFSSMGKPFIDLIFFSVYLRDNLGTGAIIGIFANYFATAIMLKKATPRFGKLAAKRTHLEGVYFNQQLNIMTNSEEIGFYKGSKIEKSKLAENFDKLMGHVSREINLSSSYAALEDYVLKYTWSAWGYIFSGLPVFLDVLFPKEDPSSGHIADIDDDDHAHGHGHTGEETSSTTENMKTFVTNKRLLLSLADAGSRLMVSLKEVTTLTGITNRVFNMLTQLHRVHDPKFDYGDKYGLPDIHGTYQLNYDGLRLEHVPITVPTAEGSYSTPLIPDLTFDIKGKNLLFVGPNGSGKTSVARVLAGLWPLYAGLVSKPSDLFFNPQKSYFTTGSLRDQVVYPNRSENTTNDQIFHILHCVHLDHIVKRYGLNQNLDFAKTLSGGEKQRLSFARVLFNRPSIVILDDSTSALSPDMEELMYQVLQDHKINYVTLSNRPSLSKFHDKVFEI

SEQ ID NO: 41 - protein, 665 aa, Candida viswanathii
MTVENAKLQKNSLAVSLLKVYKSNRSLLLNTSYIILIIAAFTGATNTGRGTSSRSSAKVETDEEQSVKKKHPKLSRESFHRLRKAILPTFFDRTIVYFFANLTLLVVRALLTLRVATLDGQLVGALVSRRIRVFAKYLLYWMLLGIPAALTNALLNWTKSNLSKSIRMNLNNNIMEEYLPDNLDPNYYSLIHLTDNKIRDPNQRITTDTSRLSDALASLPGHILKPTLDIILCAQQLSKSGVGNGEGTLALGILAHFSTMIIRFFSPPFAKLAAERANLEGQLRSAHSKIVANSEEIAFLGGHDRELDHIDHCYYTLERFSKGEYWKRAIHEITQTFIVKYFWGVAGLVLCSAPVFIAKYLGEPEDKNVAGNFITNRRLLMSASDSLDRLIYSRRYLLQVVGHATRVSDFLDTLHEVEEKKKRITSNVQFNNDEITFDHVRLMTPTEVTLIPDLNFSIKPGDHLLIVGPNGSGKSSLFRMLGGLWPVRFGTIRIPNTENMFYLPQKAYLVEGSFREQIIYPHNVTQQKKTDQQLKEILKVLKLEDYSGQLDEVKKWSEELSIGAQQRLAMARLYYHEPKFAVLDECTSAVSPDMEQLMYQHAQGLGITLLSVAHRPALWHFHKYLLEFDGKGSYYFGTLDEKHKMKLEEEERLKKENEKKSVAKK

SEQ ID NO: 42 - protein, 650 aa, Yarrowia lipolytica
MSANENISRFDAPVGKEHPAYELFHNHTRSFVYGLQPRACQGMLDFDFICKRENPSVAGVIYPFGGQFVTKMYWGTKETLLPVYQQVEKAAAKHPEVDVVVNFASSRSVYSSTMELLEYPQFRTIAIIAEGVPERRAREILHKAQKKGVTIIGPATVGGIKPGCFKVGNTGGMMDNIVASKLYRPGSVAYVSKSGGMSNELNNIISHTTDGVYEGIAIGGDRYPGTTFIDHILRYEADPKCKIIVLLGEVGGVEEYRVIEAVKNGQIKKPIVAWAIGTCASMFKTEVQFGHAGSMANSDLETAKAKNAAMKSAGFYVPDTFEDMPEVLAELYEKMVAKGELSRISEPEVPKIPIDYSWAQELGLIRKPAAFISTISDDRGQELLYAGMPISEVFKEDIGIGGVMSLLWFRRRLPDYASKFLEMVLMLTADHGPAVSGAMNTIITTRAGKDLISSLVAGLLTIGTRFGGALDGAATEFTTAYDKGLSPRQFVDTMRKQNKLIPGIGHRVKSRNNPDFRVELVKDFVKKNFPSTQLLDYALAVEEVTTSKKDNLILNVDGAIAVSFVDLMRSCGAFTVEETEDYLKNGVLNGLFVLGRSIGLIAHHLDQKRLKTGLYRHPWDDITYLVGQEAIQKKRVEISAGDVSKAKTRS

SEQ ID NO: 43 - protein, 497 aa, Yarrowia lipolytica
MSAKSIHEADGKALLAHFLSKAPVWAEQQPINTFEMGTPKLASLTFEDGVAPEQIFAAAEKTYPWLLESGAKFVAKPDQLIKRRGKAGLLVLNKSWEECKPWIAERAAKPINVEGIDGVLRTFLVEPFVPHDQKHEYYINIHSVREGDWILFYHEGGVDVGDVDAKAAKILIPVDIENEYPSNATLTKELLAHVPEDQHQTLLDFINRLYAVYVDLQFTYLEINPLVVIPTAQGVEVHYLDLAGKLDQTAEFECGPKWAAARSPAALGQVVTIDAGSTKVSIDAGPAMVFPAPFGRELSKEEAYIAELDSKTGASLKLTVLNAKGRIWTLVAGGGASVVYADAIASAGFADELANYGEYSGAPNETQTYEYAKTVLDLMTRGDAHPEGKVLFIGGGIANFTQVGSTFKGIIRAFRDYQSSLHNHKVKIYVRRGGPNWQEGLRLIKSAGDELNLPMEIYGPDMHVSGIVPLALLGKRPKNVKPFGTGPSTEASTPLGV

SEQ ID NO: 44 - protein, 650 aa, Candida viswanathii
MSGLEIAAAAILGSQLLEAKYLIADDVSLAKTVAVNALPYLWKASRGKASYWYFFEQSVFKNPNNKALAFPRPRKNAPTPKTDAEGFQIYDDQFDLEEYTYKELYDMVLKYSYILKNEYGVTANDTIGVSCMNKPLFIVLWLALWNIGALPAFLNFNTKDKPLIHCLKIVNASQVFVDPDCDSPIRDTEAQIREELPHVQINYIDEFALFDRLRLKSTPKHRAEDKTRRPTDTDSSACALIYTSGTTGLPKAGIMSWRKAFMASVFFGHIMKIDSKSNVLTAMPLYHSTAAMLGLCPTLIVGGCVSVSQKFSATSFWTQARLCGATHVQYVGEVCRYLLNSKPHPDQDRHNVRIAYGNGLRPDIWSEFKRRFHIEGIGEFYAATESPIATTNLQYGEYGVGACRKYGSLISLLLSTQQKLAKMDPEDESEIYKDPKTGFCTEAAYNEPGELLMRILNPNDVQKSFQGYYGNKSATNSKILTNVFKKGDAWYRSGDLLKMDEDKLLYFVDRLGDTFRWKSENVSATEVENELMGSKALKQSVVVGVKVPNHEGRACFAVCEAKDELSHEEILKLIHSHVTKSLPVYAQPAFIKIGTIEASHNHKVPKNQFKNQKLPKGEDGKDLIYWLNGDKYQELTEDDWSLICTGKAKL

SEQ ID NO: 45 - protein, 517 aa, Artificial Sequence
  Description of Artificial Sequence: Synthetic polypeptide
MIEQLLEYWYVVVPVLYIIKQLLAYTKTRVLMKKLGAAPVTNKLYDNAFGIVNGWKALQFKKEGRAQEYNDYKFDHSKNPSVGTYVSILFGTRIVVTKDPENIKAILATQFGDFSLGKRHTLFKPLLGDGIFTLDGEGWKHSRAMLRPQFAREQVAHVTSLEPHFQLLKKHILKHKGEYFDIQELFFRFTVDSATEFLFGESVHSLKDESIGINQDDIDFAGRKDFAESFNKAQEYLAIRTLVQTFYWLVNNKEFRDCTKSVHKFTNYYVQKALDASPEELEKQSGYVFLYELVKQTRDPNVLRDQSLNILLAGRDTTAGLLSFAVFELARHPEIWAKLREEIEQQFGLGEDSRVEEITFESLKRCEYLKAFLNETLRIYPSVPRNFRIATKNTTLPRGGGSDGTSPILIQKGEAVSYGINSTHLDPVYYGPDAAEFRPERWFEPSTKKLGWAYLPFNGGPRICLGQQFALTEAGYVLVRLVQEFSHVRSDPDEVYPPKRLTNLTMCLQDGAIVKFD

SEQ ID NO: 46 - protein, 418 aa, Candida viswanathii
MHALFSKSVFLKYVSSPTTSAIPHSLEFIVSRSSYLRRRIPPYLPRCSHFPSFYYSSSSVYTKKSFHTMSANIPKTQKAVVFEKNGGELKYKDIPVPTPKANELLINVKYSGVCHTDLHAWKGDWPLDTKLPLVGGHEGAGVVVGMGENVKGWKIGDFAGIKWLNGSCMSCEFCQQGAEPNCGEADLSGYTHDGSFEQYATADAVQAARIPAGTDLAEVAPILCAGVTVYKALKTADLAAGQWVAISGAGGGLGSLAVQYAVAMGLRVVAIDGGDEKGDFVKSLGAEAYIDFLKEKGIVAAVKKATDGGPHGAINVSVSEKAIDQSVEYVRPLGKVVLVGLPAGSKVTAGVFEAVVKSIEIKGSYVGNRKDTAEAVDFFSRGLIKCPIKIVGLSELPQVFKLMEEGKILGRYVLDTSK

SEQ ID NO: 47 - protein, 704 aa, Candida viswanathii
MAPFLPDQVDYKHVDTLMLLCDGIIHETTVDQIKDVIAPDFPADKYEEYVRTFTKPSETPGFRETVYNTVNANTTDAIHQFIILTNVLASRVLAPALTNSLTPIKDMSLEDREKLLASWRDSPIAAKRKLFRLVSTLTLVTFTRLANELHLKAIHYPGREDREKAYETQEIDPFKYQFLEKPKFYGAELYLPDIDVIIIGSGAGAGVVAHTLANDGFKSLVLEKGKYFSNSELNFDDKDGVQELYQSGGTLTTVNQQLFVLAGSTFGGGTTVNWSACLKTPFKVRKEWYDEFGVDFAADEAYDKAQDYVWQQMGASTEGITHSLANEIIIEGGKKLGYKAKVLDQNSGGHPQHRCGFCYLGCKHGIKQGSVNNWFRDAAAHGSQFMQQVRVLQILNKKGIAYGILCEDVVTGAKFTITGPKKFVVAAGALNTPSVLVNSGFKNKNIGKNLTLHPVSVVFGDFGKDVQADHFHNSIMTALCSEAADLDGKGHGCRIETILNAPFIQASFLPWRGSNEARRDLLRYNNMVAMLLLSRDTTSGSVSAHPTKPEALVVEYDVNKFDRNSILQALLVTADLLYIQGAKRILSPQAWVPIFESDKPKDKRSIKDEDYVEWRAKVAKIPFDTYGSPYGSAHQMSSCRMSGKGPKYGAVDTDGRLFECSNVYVADASLLPTASGANPMVTTMTLARHVALGLADSLKTKAKL

SEQ ID NO: 48 - protein, 342 aa, Candida viswanathii
MLRSSVRTFSTQSRVLANYGFVGLGLMGQHMARHVYNQLQPADKLYVHDVNPQHTTQFVTDVTTQKPQNATQLTPLSSLKEFTTEPESQLDFIVTMVPEGKHVKAVVSELVDHYNASGKYDPSKKLTFVDSSTIDIPTSREVHQLVADKLQGATFIDAPVSGGVAGARNGTLSFMVSRDTKEDVDPNLVTLLNYMGSNIFPCGGTHGTGLAAKLANNYLLAITNIAVADSFQLANSFGLNLQNYAKLVSTSTGKSWASVDNCPIPGVYPEKNLTCDNGYKGGFVTKLTRKDVVLATESAKANNQFLMLGEVGRYWYDKACEDEKYANRDLSVLFEFLGDLKK

SEQ ID NO: 49 - protein, 549 aa, Candida viswanathii
MLSRVLFKTKPRVPTKSITAMAIRNKSIVTLSSTTSTYPTDHTTPSTEPYITPSFVNNEFIKSDSNTWFDVHDPATNYVVSKVPQSTPEELEEAIASAHAAFPKWRDTSIIKRQGIAFKFVQLLRENMDRIASVIVLEQGKTFVDAQGDVTRGLQVAEAACNITNDLKGESLEVSTDMETKMIREPLGVVGSICPFNFPAMVPLWSLPLVLVTGNTAVIKPSERVPGASMIICELAAKAGVPPGVLNIVHGKHDTVNKLIEDPRIKALTFVGGDKAGKYIYEKGSSLGKRVQANLGAKNHLVVLPDAHKQSFVNAVNGAAFGAAGQRCMAISVLVTVGKTKEWVQDVIKDAKLLNTGSGFDPKSDLGPVINPESLTRAEEIIADSVANGAVLELDGRGYRPEDARFAKGNFLGPTILTNVKPGLRAYDEEIFAPVLSVVNVDTIDEAIELINNNKYGNGVSLFTSSGGSAQYFTKRIDVGQVGINVPIPVPLPMFSFTGSRGSFLGDLNFYGKAGITFLTKPKTITSAWKTNLIDDEILKPSTSMPVQQ

SEQ ID NO: 50 - protein, 241 aa, Candida viswanathii
MSDEESDILYEVRDRTAIITLNIPKRLNALNGAQYLKLGKFLERANNEEDTVLTLIQASGRFFSAGANFADNDMAKVEMSKLFSHEYWLERFVARNIWLTNLFNDHKKILAAAVNGPVIGLSTGLLLLVDLVYVHDLNKFYLLAPFANLGLVAEGASSATLFNRLGWSKASEALLLAKPIGGQDCYNAGFINKHYDGKFSSTEEFNEHVYKELTEAFENLHDDSILQNKQLLKLSRDQAIN

SEQ ID NO: 51 - protein, 268 aa, Candida viswanathii
MSDDLITYEVKDRAAVITLNNPKKLNALSIPQYDTICKLLERANAEEDTVITLLQSTGRVFSAGANADSIVGQDAELETWLNMSVAKQTFLVQTFLAHKKILAVALNGPVIGLSAAFVALCDLVYVHNAAKTFFLTPFANIGILAEGGTSATLPMRVGWSRAAEALLLSKRISGDDLQRAGFFNKDYKGQFKSAEEFNEVVLKELLDATENLHEDSIIQNKELLKAIFKPKISEVNSQEVSRGVYKWTSGVPMDRFKKLLNGELKHKL

SEQ ID NO: 52 - protein, 291 aa, Candida viswanathii
MPNTLDHNYLKKSVWKSDIFAGKVIFITGGAGTICRVQAEAMVLLGANAAIIGRNVEKTEEAAKEIASLRPGAKVIGIGAVDVRKIQTIKDAVDRTVAELGRIDYVIAGAAGNFLCDFNHLSANAFKSVIDIDLLGSFNTVKVTFDQLRKNKGAVLFVSATLHYTGVPMQSHVGAAKSGVDALSNALAVELGPLGIRFNCIAPGAIAGTEGMSRLAPPTDTPLETKIPLQRQGTTEDIADATVFLFSPASSYITGDVLVVDGAMWQTGGGILNDFYPDIIIHQNADPEGKL

SEQ ID NO: 53 - protein, 292 aa, Candida viswanathii
MPNTLTEAYKQESSWKPDLFKGKVVFITGGAGSICRVQAEAMVLLGANAAIIGRNVEKTESAAKEIASLRSGAKVLGIGGIDVRKVDSLKSAVDKTVAELGRIDFVIAGAAGNFLCDFNHLSSNAFKSIIDIDLLGSFNTVKVTFDQLRKNKGAILFVSATLHYYGVPFQIGVGAAKAGVDALSNALAVELGPLGIRSNCIAPGPIDGTEGVERLVRASKAEAAKKVPLQRLGTTQDIADGTVYLFSPAASFVTGDVLVVDGASWQISSGVGATNYPVSILNAIDAPKGGKL

SEQ ID NO: 54 - DNA, 804 bp, Candida viswanathii
atggttagcacaaaaacatacacagaaagggcatcagcacacccctccaaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataa

SEQ ID NO: 55 - DNA, 415 bp, Candida viswanathii
cgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgca

SEQ ID NO: 56 - DNA, 267 bp, Candida viswanathii
taaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtct

SEQ ID NO: 57 - DNA, 1961 bp, Artificial Sequence
  Description of Artificial Sequence: Synthetic polynucleotide
ttaaaggtatctacggttgtttcggtatgacccccggggatctgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccaaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctacggtcgacgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcagagctcggtaccc

SEQ ID NO: 58 - DNA, 1731 bp, Artificial Sequence
  Description of Artificial Sequence: Synthetic polynucleotide
taaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctcgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccaaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaca

SEQ ID NO: 59 - DNA, 1884 bp, Candida viswanathii
atgtttaactttaagttgtcgcaacaagtattaaagaattccaccaaatccattatgccaattttgaaaaaaccattctccaccagccacgcaaagggtgacttgttcaaataccagtcacaattacccaagttgcctgttcctactttggaagaaaccgcatccaagtacctcaagaccgttgagccattcttgaaccaagagcaattggaatccaccaaggccaaagtcgctgagtttgttagaccaggtggtgccggtgaagccttgcaagccagattgaacaactttgccgccgacaaggacaactggttggctgaattttgggacgactatgcatacatgtcttatagagatcctgttgttccatatgtttcttactttttcagtcacaaggatgtcaagaacatcattggccaagaccaattgttgaaggccactttgattgcttactacactattgagttccaagaaaaggttttggacgaaagtttggacccagaagtcatcaagggtaacccattctgtatgaacgccttcaagtacatgttcaacaactcgagagttccagctgaaggctccgacatcacccaacactacaacggtgaagaaaaccaatttttcgttgtcatctacaagaacaacttctacaaggttccaacccacaagaacggccaaagattgaccaagggtgaaatctacagctacttgcaagaaatcaagaacgatgccactccaaagggtctcggtttgggtgctttgacctcattgaacagagacgaatggttgagtgcctacaacaacttgttgaagtccccaatcaacgaagcttccttgggatccatctttgcttccagctttgtcattgccttggactccaacaacccagtcaccattgaagaaaaatccaagaactgctggcacggggacggtcaaaacagattctttgacaagcctttggaattcttcgtcagtgctaacggtaactctggtttccttggtgaacactccagaatggacgctaccccaaccgtgcaattgaacaacaccatctacaagcaaatcttggaaaccaatccaaacgacttgattgttgaaattggttcttctgctccaagattcggcaatgctgaaatcttgcctttcgacatcaacccaaccaccagagccaacatcaaagacgctattgccaagtttgacgccaccattgctgcccacgacgaagaaatcttccaacactacggttacggtaagggattgatcaagaagttcaaggtctccccagatgcctacgtgcaattgttgatgcaattggcatacttcaagtacaccggcaagatcagaccaacttatgaatccgccgccaccagaaagttcttgaagggtagaaccgaaaccggtagaactgtttccaacgaatccaagaagtttgttgagacctggtccgatccaaacgctagcagcgccgacaaggttgccactttccaagctgccgctaagcaacacgttgcttacttgtctgctgccgccgatggtaagggtgtcgaccgtcacttgtttggtttgaagcagatgattcaaccaggcgaaccaatccctgaaatcttcactgacccaatctttagctattctcaaacctggtacatttcttcttcccaagtcccatctgaattcttccaatcttggggttggtcgcaagtcattgacgacggtttcggtttggcttacttgatcaacaacgactggatccacgttcacatttcttgtaagagaggtaacggcttgcaatccgaccacttgaaatggtacttggttgatagtgctaacgaaatgaaggatgtcttgactaagggattattgactgatgctaagcctaagttgtaa

SEQ ID NO: 60 - DNA, 1830 bp, Artificial Sequence
  Description of Artificial Sequence: Synthetic polynucleotide
atgccaattttgaaaaaaccattctccaccagccacgcaaagggtgacttgttcaaataccagtcacaattacccaagttgcctgttcctactttggaagaaaccgcatccaagtacctcaagaccgttgagccattcttgaaccaagagcaattggaatccaccaaggccaaagtcgctgagtttgttagaccaggtggtgccggtgaagccttgcaagccagattgaacaactttgccgccgacaaggacaactggttggctgaattttgggacgactatgcatacatgtcttatagagatcctgttgttccatatgtttcttactttttcagtcacaaggatgtcaagaacatcattggccaagaccaattgttgaaggccactttgattgcttactacactattgagttccaagaaaaggttttggacgaaagtttggacccagaagtcatcaagggtaacccattctgtatgaacgccttcaagtacatgttcaacaactcgagagttccagctgaaggctccgacatcacccaacactacaacggtgaagaaaaccaatttttcgttgtcatctacaagaacaacttctacaaggttccaacccacaagaacggccaaagattgaccaagggtgaaatctacagctacttgcaagaaatcaagaacgatgccactccaaagggtctcggtttgggtgctttgacctcattgaacagagacgaatggttgagtgcctacaacaacttgttgaagtccccaatcaacgaagcttccttgggatccatctttgcttccagctttgtcattgccttggactccaacaacccagtcaccattgaagaaaaatccaagaactgctggcacggggacggtcaaaacagattctttgacaagcctttggaattcttcgtcagtgctaacggtaactctggtttccttggtgaacactccagaatggacgctaccccaaccgtgcaattgaacaacaccatctacaagcaaatcttggaaaccaatccaaacgacttgattgttgaaattggttcttctgctccaagattcggcaatgctgaaatcttgcctttcgacatcaacccaaccaccagagccaacatcaaagacgctattgccaagtttgacgccaccattgctgcccacgacgaagaaatcttccaacactacggttacggtaagggattgatcaagaagttcaaggtctccccagatgcctacgtgcaattgttgatgcaattggcatacttcaagtacaccggcaagatcagaccaacttatgaatccgccgccaccagaaagttcttgaagggtagaaccgaaaccggtagaactgtttccaacgaatccaagaagtttgttgagacctggtccgatccaaacgctagcagcgccgacaaggttgccactttccaagctgccgctaagcaacacgttgcttacttgtctgctgccgccgatggtaagggtgtcgaccgtcacttgtttggtttgaagcagatgattcaaccaggcgaaccaatccctgaaatcttcactgacccaatctttagctattctcaaacctggtacatttcttcttcccaagtcccatctgaattcttccaatcttggggttggtcgcaagtcattgacgacggtttcggtttggcttacttgatcaacaacgactggatccacgttcacatttcttgtaagagaggtaacggcttgcaatccgaccacttgaaatggtacttggttgatagtgctaacgaaatgaaggatgtcttgactaagggattattgactgatgctaagcctaagttgtaa

SEQ ID NO: 61 - DNA, 1821 bp, Artificial Sequence
  Description of Artificial Sequence: Synthetic polynucleotide
atgccaattttgaaaaaaccattctccaccagccacgcaaagggtgacttgttcaaataccagtcacaattacccaagttgcctgttcctactttggaagaaaccgcatccaagtacctcaagaccgttgagccattcttgaaccaagagcaattggaatccaccaaggccaaagtcgctgagtttgttagaccaggtggtgccggtgaagccttgcaagccagattgaacaactttgccgccgacaaggacaactggttggctgaattttgggacgactatgcatacatgtcttatagagatcctgttgttccatatgtttcttactttttcagtcacaaggatgtcaagaacatcattggccaagaccaattgttgaaggccactttgattgcttactacactattgagttccaagaaaaggttttggacgaaagtttggacccagaagtcatcaagggtaacccattctgtatgaacgccttcaagtacatgttcaacaactcgagagttccagctgaaggctccgacatcacccaacactacaacggtgaagaaaaccaatttttcgttgtcatctacaagaacaacttctacaaggttccaacccacaagaacggccaaagattgaccaagggtgaaatctacagctacttgcaagaaatcaagaacgatgccactccaaagggtctcggtttgggtgctttgacctcattgaacagagacgaatggttgagtgcctacaacaacttgttgaagtccccaatcaacgaagcttccttgggatccatctttgcttccagctttgtcattgccttggactccaacaacccagtcaccattgaagaaaaatccaagaactgctggcacggggacggtcaaaacagattctttgacaagcctttggaattcttcgtcagtgctaacggtaactctggtttccttggtgaacactccagaatggacgctaccccaaccgtgcaattgaacaacaccatctacaagcaaatcttggaaaccaatccaaacgacttgattgttgaaattggttcttctgctccaagattcggcaatgctgaaatcttgcctttcgacatcaacccaaccaccagagccaacatcaaagacgctattgccaagtttgacgccaccattgctgcccacgacgaagaaatcttccaacactacggttacggtaagggattgatcaagaagttcaaggtctccccagatgcctacgtgcaattgttgatgcaattggcatacttcaagtacaccggcaagatcagaccaacttatgaatccgccgccaccagaaagttcttgaagggtagaaccgaaaccggtagaactgtttccaacgaatccaagaagtttgttgagacctggtccgatccaaacgctagcagcgccgacaaggttgccactttccaagctgccgctaagcaacacgttgcttacttgtctgctgccgccgatggtaagggtgtcgaccgtcacttgtttggtttgaagcagatgattcaaccaggcgaaccaatccctgaaatcttcactgacccaatctttagctattctcaaacctggtacatttcttcttcccaagtcccatctgaattcttccaatcttggggttggtcgcaagtcattgacgacggtttcggtttggcttacttgatcaacaacgactggatccacgttcacatttcttgtaagagaggtaacggcttgcaatccgaccacttgaaatggtacttggttgatagtgctaacgaaatgaaggatgtcttgactaagggattattgactgatgctaagtaa

SEQ ID NO: 62 - DNA, 1875 bp, Artificial Sequence
  Description of Artificial Sequence: Synthetic polynucleotide
atgtttaactttaagttgtcgcaacaagtattaaagaattccaccaaatccattatgccaattttgaaaaaaccattctccaccagccacgcaaagggtgacttgttcaaataccagtcacaattacccaagttgcctgttcctactttggaagaaaccgcatccaagtacctcaagaccgttgagccattcttgaaccaagagcaattggaatccaccaaggccaaagtcgctgagtttgttagaccaggtggtgccggtgaagccttgcaagccagattgaacaactttgccgccgacaaggacaactggttggctgaattttgggacgactatgcatacatgtcttatagagatcctgttgttccatatgtttcttactttttcagtcacaaggatgtcaagaacatcattggccaagaccaattgttgaaggccactttgattgcttactacactattgagttccaagaaaaggttttggacgaaagtttggacccagaagtcatcaagggtaacccattctgtatgaacgccttcaagtacatgttcaacaactcgagagttccagctgaaggctccgacatcacccaacactacaacggtgaagaaaaccaatttttcgttgtcatctacaagaacaacttctacaaggttccaacccacaagaacggccaaagattgaccaagggtgaaatctacagctacttgcaagaaatcaagaacgatgccactccaaagggtctcggtttgggtgctttgacctcattgaacagagacgaatggttgagtgcctacaacaacttgttgaagtccccaatcaacgaagcttccttgggatccatctttgcttccagctttgtcattgccttggactccaacaacccagtcaccattgaagaaaaatccaagaactgctggcacggggacggtcaaaacagattctttgacaagcctttggaattcttcgtcagtgctaacggtaactctggtttccttggtgaacactccagaatggacgctaccccaaccgtgcaattgaacaacaccatctacaagcaaatcttggaaaccaatccaaacgacttgattgttgaaattggttcttctgctccaagattcggcaatgctgaaatcttgcctttcgacatcaacccaaccaccagagccaacatcaaagacgctattgccaagtttgacgccaccattgctgcccacgacgaagaaatcttccaacactacggttacggtaagggattgatcaagaagttcaaggtctccccagatgcctacgtgcaattgttgatgcaattggcatacttcaagtacaccggcaagatcagaccaacttatgaatccgccgccaccagaaagttcttgaagggtagaaccgaaaccggtagaactgtttccaacgaatccaagaagtttgttgagacctggtccgatccaaacgctagcagcgccgacaaggttgccactttccaagctgccgctaagcaacacgttgcttacttgtctgctgccgccgatggtaagggtgtcgaccgtcacttgtttggtttgaagcagatgattcaaccaggcgaaccaatccctgaaatcttcactgacccaatctttagctattctcaaacctggtacatttcttcttcccaagtcccatctgaattcttccaatcttggggttggtcgcaagtcattgacgacggtttcggtttggcttacttgatcaacaacgactggatccacgttcacatttcttgtaagagaggtaacggcttgcaatccgaccacttgaaatggtacttggttgatagtgctaacgaaatgaaggatgtcttgactaagggattattgactgatgctaagtaa

SEQ ID NO: 63 - DNA, 2301 bp, Candida viswanathii
atgtcaacttaccagttccaagaaactttagaaaagcttccaatcccagacttaaaccaaacatgcgctaactacctcaacgtcttgcgtccgctccaaacagagcaagaacacatcaagaccaagactgccgttgagaatttcctcaagaatggcaccggccagtacctcgacgctgccttgcgcgaatacgcccagacccgccccagctacattgaacagttctggtacgacgcatacttaaactacgactcccccgttgttttaaacttgaatccgtttttcttactcgaagacgacccattcaccaacgagtccagctccgtcaatccccaggttaagcgtgccaccagcttggtgatgtcctcgttgaagttcatccaggcgttgaagaacgagacgttgagcgtcgacaccttgaaaggaggcaagccgttgtgcatgtaccagtacaccaaattgtttggggcgctgcgtatcccctccgaggacgggtgtgtgatgcagagcgacccggcaagtaaccacattgtcgtgatgtctaagtcccagttgtattggtttgacgtgttggatagcaagaacaacttgattttgagcgaagcggagttgaatgtgaacttccagtcgatcattcatgactctttgagaactccctcggatgagattgcaaagagctcgtttggggtgttgacgacggagaatagaagaatttgggctaatgttagacataatttgatgtcgactaccaataataaggttaaccatgaggtgttgtcgattattgactcagcgttgtttgtgttatgctttgatgatatcgtgattaatgacttgtcggagttgtccaagaatatgctttgtgggttgtccattttggataatggtatccaagtgggtacttgtacaaacagatggtatgacaagttgcagattatcgttaccaagaatgccaaagccggtattaatttcgaacatactggtgttgacggtcatacggtgttgagatttgtcagtgatatctacaccgactccatcttgtcctttgccaactccatcaatagcaacgctccatctttatggaacaccactacaaactacaaagaacttgatggggaagatttaatcaccgtgccacgtaagttggaatgggagttgacccctgacttatccttggctttgagatttggagaaaccagattgtcggacttgatcaaccagaacgagttccgccacttggagttcaagaactatgggtctacacaaatcaagaagatgaagttctcaccagatgcgtttgttcaaatggcgttccaagcaacctactatgcgctttacggtaaggttgaatgtacttatgagccagccatgacgaagcagttctaccacggaagaacagaagctataagaaccgtctcgcaagaatcgaacttgtttgtgcgtaagttctttgactccactgtgtccatccagaagaagttagagtacttgacccaagcttgcaccaagcactcccagcaaaccagaatgagttctgccggtcaaggtgtcgatcgtcacttgtatgctttattctgtatctggaagagatacttacacgatgccgaagacgacgatgacgatgcctccaaagaccaaccatcatcgacggaattatcccgtgatgacaccatcattgctcaaaccaacggtgacagcaccgatgatgacgactccaccaccgttgtcggacacggcgccaaccaccatcacaacttgaaaagcgccgatttgttgaaaaccatccctgagatattcgcagacaatggctgggacaagttgaacaacacgatcatatccacctccaactgtggtaatccttctttgagattgtttggatttggtcctgtttcagctaacgggtttggtatcgggtatatcttgaaggacgactcgatctcgatctgtgcttcgtcgaagcatcgtcagacgcagagattcttggtcactttgaactcgtacttgttggagatccagaacatctggaaacaagcgcaaaagatggagaagttgaaggctgagttggctaaagccgtcgaggatgcaaaacctaagggacagaaatcaggtgaagcagaggggatcatcgagcctaagcctaataacttgagcactcttttgggaggttatggttatttcgatatgggcgatgaggacatcaagagcagaggacaatctccagaacctccgttcttgcatcgtgctggatccggtttcagcattcgtgaaataggcaagaagttgagattaagcgagtattag

SEQ ID NO: 64 - DNA, 90 bp, Candida viswanathii
atgctttcccgtaccactttaagagttgccagacaacaaaccagattattgtctacttccagaatcttgttcaacagcaagaccgaccaa

SEQ ID NO: 65 - DNA, 75 bp, Candida viswanathii
atgtctgcattaagatcattccaacgctcttctaacgttgctaagtccaccttaaagaactcagtcagaacctat

SEQ ID NO: 66 - DNA, 99 bp, Candida viswanathii
atgtttaactttaagttgtcgcaacaagtattaaagaattccaccaaatccattatgccaattttgaaaaaaccattctccaccagccacgcaaagggt

SEQ ID NO: 67 - DNA, 2388 bp, Artificial Sequence
  Description of Artificial Sequence: Synthetic polynucleotide
atgctttcccgtaccactttaagagttgccagacaacaaaccagattattgtctacttccagaatcttgttcaacagcaagaccgaccaatcaacttaccagttccaagaaactttagaaaagcttccaatcccagacttaaaccaaacatgcgctaactacctcaacgtcttgcgtccgctccaaacagagcaagaacacatcaagaccaagactgccgttgagaatttcctcaagaatggcaccggccagtacctcgacgctgccttgcgcgaatacgcccagacccgccccagctacattgaacagttctggtacgacgcatacttaaactacgactcccccgttgttttaaacttgaatccgtttttcttactcgaagacgacccattcaccaacgagtccagctccgtcaatccccaggttaagcgtgccaccagcttggtgatgtcctcgttgaagttcatccaggcgttgaagaacgagacgttgagcgtcgacaccttgaaaggaggcaagccgttgtgcatgtaccagtacaccaaattgtttggggcgctgcgtatcccctccgaggacgggtgtgtgatgcagagcgacccggcaagtaaccacattgtcgtgatgtctaagtcccagttgtattggtttgacgtgttggatagcaagaacaacttgattttgagcgaagcggagttgaatgtgaacttccagtcgatcattcatgactctttgagaactccctcggatgagattgcaaagagctcgtttggggtgttgacgacggagaatagaagaatttgggctaatgttagacataatttgatgtcgactaccaataataaggttaaccatgaggtgttgtcgattattgactcagcgttgtttgtgttatgctttgatgatatcgtgattaatgacttgtcggagttgtccaagaatatgctttgtgggttgtccattttggataatggtatccaagtgggtacttgtacaaacagatggtatgacaagttgcagattatcgttaccaagaatgccaaagccggtattaatttcgaacatactggtgttgacggtcatacggtgttgagatttgtcagtgatatctacaccgactccatcttgtcctttgccaactccatcaatagcaacgctccatctttatggaacaccactacaaactacaaagaacttgatggggaagatttaatcaccgtgccacgtaagttggaatgggagttgacccctgacttatccttggctttgagatttggagaaaccagattgtcggacttgatcaaccagaacgagttccgccacttggagttcaagaactatgggtctacacaaatcaagaagatgaagttctcaccagatgcgtttgttcaaatggcgttccaagcaacctactatgcgctttacggtaaggttgaatgtacttatgagccagccatgacgaagcagttctaccacggaagaacagaagctataagaaccgtctcgcaagaatcgaacttgtttgtgcgtaagttctttgactccactgtgtccatccagaagaagttagagtacttgacccaagcttgcaccaagcactcccagcaaaccagaatgagttctgccggtcaaggtgtcgatcgtcacttgtatgctttattctgtatctggaagagatacttacacgatgccgaagacgacgatgacgatgcctccaaagaccaaccatcatcgacggaattatcccgtgatgacaccatcattgctcaaaccaacggtgacagcaccgatgatgacgactccaccaccgttgtcggacacggcgccaaccaccatcacaacttgaaaagcgccgatttgttgaaaaccatccctgagatattcgcagacaatggctgggacaagttgaacaacacgatcatatccacctccaactgtggtaatccttctttgagattgtttggatttggtcctgtttcagctaacgggtttggtatcgggtatatcttgaaggacgactcgatctcgatctgtgcttcgtcgaagcatcgtcagacgcagagattcttggtcactttgaactcgtacttgttggagatccagaacatctggaaacaagcgcaaaagatggagaagttgaaggctgagttggctaaagccgtcgaggatgcaaaacctaagggacagaaatcaggtgaagcagaggggatcatcgagcctaagcctaataacttgagcactcttttgggaggttatggttatttcgatatgggcgatgaggacatcaagagcagaggacaatctccagaacctccgttcttgcatcgtgctggatccggtttcagcattcgtgaaataggcaagaagttgagattaagcgagtattag

SEQ ID NO: 68 - DNA, 2373 bp, Artificial Sequence
  Description of Artificial Sequence: Synthetic polynucleotide
atgtctgcattaagatcattccaacgctcttctaacgttgctaagtccaccttaaagaactcagtcagaacctattcaacttaccagttccaagaaactttagaaaagcttccaatcccagacttaaaccaaacatgcgctaactacctcaacgtcttgcgtccgctccaaacagagcaagaacacatcaagaccaagactgccgttgagaatttcctcaagaatggcaccggccagtacctcgacgctgccttgcgcgaatacgcccagacccgccccagctacattgaacagttctggtacgacgcatacttaaactacgactcccccgttgttttaaacttgaatccgtttttcttactcgaagacgacccattcaccaacgagtccagctccgtcaatccccaggttaagcgtgccaccagcttggtgatgtcctcgttgaagttcatccaggcgttgaagaacgagacgttgagcgtcgacaccttgaaaggaggcaagccgttgtgcatgtaccagtacaccaaattgtttggggcgctgcgtatcccctccgaggacgggtgtgtgatgcagagcgacccggcaagtaaccacattgtcgtgatgtctaagtcccagttgtattggtttgacgtgttggatagcaagaacaacttgattttgagcgaagcggagttgaatgtgaacttccagtcgatcattcatgactctttgagaactccctcggatgagattgcaaagagctcgtttggggtgttgacgacggagaatagaagaatttgggctaatgttagacataatttgatgtcgactaccaataataaggttaaccatgaggtgttgtcgattattgactcagcgttgtttgtgttatgctttgatgatatcgtgattaatgacttgtcggagttgtccaagaatatgctttgtgggttgtccattttggataatggtatccaagtgggtacttgtacaaacagatggtatgacaagttgcagattatcgttaccaagaatgccaaagccggtattaatttcgaacatactggtgttgacggtcatacggtgttgagatttgtcagtgatatctacaccgactccatcttgtcctttgccaactccatcaatagcaacgctccatctttatggaacaccactacaaactacaaagaacttgatggggaagatttaatcaccgtgccacgtaagttggaatgggagttgacccctgacttatccttggctttgagatttggagaaaccagattgtcggacttgatcaaccagaacgagttccgccacttggagttcaagaactatgggtctacacaaatcaagaagatgaagttctcaccagatgcgtttgttcaaatggcgttccaagcaacctactatgcgctttacggtaaggttgaatgtacttatgagccagccatgacgaagcagttctaccacggaagaacagaagctataagaaccgtctcgcaagaatcgaacttgtttgtgcgtaagttctttgactccactgtgtccatccagaagaagttagagtacttgacccaagcttgcaccaagcactcccagcaaaccagaatgagttctgccggtcaaggtgtcgatcgtcacttgtatgctttattctgtatctggaagagatacttacacgatgccgaagacgacgatgacgatgcctccaaagaccaaccatcatcgacggaattatcccgtgatgacaccatcattgctcaaaccaacggtgacagcaccgatgatgacgactccaccaccgttgtcggacacggcgccaaccaccatcacaacttgaaaagcgccgatttgttgaaaaccatccctgagatattcgcagacaatggctgggacaagttgaacaacacgatcatatccacctccaactgtggtaatccttctttgagattgtttggatttggtcctgtttcagctaacgggtttggtatcgggtatatcttgaaggacgactcgatctcgatctgtgcttcgtcgaagcatcgtcagacgcagagattcttggtcactttgaactcgtacttgttggagatccagaacatctggaaacaagcgcaaaagatggagaagttgaaggctgagttggctaaagccgtcgaggatgcaaaacctaagggacagaaatcaggtgaagcagaggggatcatcgagcctaagcctaataacttgagcactcttttgggaggttatggttatttcgatatgggcgatgaggacatcaagagcagaggacaatctccagaacctccgttcttgcatcgtgctggatccggtttcagcattcgtgaaataggcaagaagttgagattaagcgagtattag

SEQ ID NO: 69 - DNA, 2397 bp, Artificial Sequence
  Description of Artificial Sequence: Synthetic polynucleotide
atgtttaactttaagttgtcgcaacaagtattaaagaattccaccaaatccattatgccaattttgaaaaaaccattctccaccagccacgcaaagggttcaacttaccagttccaagaaactttagaaaagcttccaatcccagacttaaaccaaacatgcgctaactacctcaacgtcttgcgtccgctccaaacagagcaagaacacatcaagaccaagactgccgttgagaatttcctcaagaatggcaccggccagtacctcgacgctgccttgcgcgaatacgcccagacccgccccagctacattgaacagttctggtacgacgcatacttaaactacgactcccccgttgttttaaacttgaatccgtttttcttactcgaagacgacccattcaccaacgagtccagctccgtcaatccccaggttaagcgtgccaccagcttggtgatgtcctcgttgaagttcatccaggcgttgaagaacgagacgttgagcgtcgacaccttgaaaggaggcaagccgttgtgcatgtaccagtacaccaaattgtttggggcgctgcgtatcccctccgaggacgggtgtgtgatgcagagcgacccggcaagtaaccacattgtcgtgatgtctaagtcccagttgtattggtttgacgtgttggatagcaagaacaacttgattttgagcgaagcggagttgaatgtgaacttccagtcgatcattcatgactctttgagaactccctcggatgagattgcaaagagctcgtttggggtgttgacgacggagaatagaagaatttgggctaatgttagacataatttgatgtcgactaccaataataaggttaaccatgaggtgttgtcgattattgactcagcgttgtttgtgttatgctttgatgatatcgtgattaatgacttgtcggagttgtccaagaatatgctttgtgggttgtccattttggataatggtatccaagtgggtacttgtacaaacagatggtatgacaagttgcagattatcgttaccaagaatgccaaagccggtattaatttcgaacatactggtgttgacggtcatacggtgttgagatttgtcagtgatatctacaccgactccatcttgtcctttgccaactccatcaatagcaacgctccatctttatggaacaccactacaaactacaaagaacttgatggggaagatttaatcaccgtgccacgtaagttggaatgggagttgacccctgacttatccttggctttgagatttggagaaaccagattgtcggacttgatcaaccagaacgagttccgccacttggagttcaagaactatgggtctacacaaatcaagaagatgaagttctcaccagatgcgtttgttcaaatggcgttccaagcaacctactatgcgctttacggtaaggttgaatgtacttatgagccagccatgacgaagcagttctaccacggaagaacagaagctataagaaccgtctcgcaagaatcgaacttgtttgtgcgtaagttctttgactccactgtgtccatccagaagaagttagagtacttgacccaagcttgcaccaagcactcccagcaaaccagaatgagttctgccggtcaaggtgtcgatcgtcacttgtatgctttattctgtatctggaagagatacttacacgatgccgaagacgacgatgacgatgcctccaaagaccaaccatcatcgacggaattatcccgtgatgacaccatcattgctcaaaccaacggtgacagcaccgatgatgacgactccaccaccgttgtcggacacggcgccaaccaccatcacaacttgaaaagcgccgatttgttgaaaaccatccctgagatattcgcagacaatggctgggacaagttgaacaacacgatcatatccacctccaactgtggtaatccttctttgagattgtttggatttggtcctgtttcagctaacgggtttggtatcgggtatatcttgaaggacgactcgatctcgatctgtgcttcgtcgaagcatcgtcagacgcagagattcttggtcactttgaactcgtacttgttggagatccagaacatctggaaacaagcgcaaaagatggagaagttgaaggctgagttggctaaagccgtcgaggatgcaaaacctaagggacagaaatcaggtgaagcagaggggatcatcgagcctaagcctaataacttgagcactcttttgggaggttatggttatttcgatatgggcgatgaggacatcaagagcagaggacaatctccagaacctccgttcttgcatcgtgctggatccggtttcagcattcgtgaaataggcaagaagttgagattaagcgagtattag

SEQ ID NO: 70 - DNA, 2310 bp, Artificial Sequence
  Description of Artificial Sequence: Synthetic polynucleotide
atgtcaacttaccagttccaagaaactttagaaaagcttccaatcccagacttaaaccaaacatgcgctaactacctcaacgtcttgcgtccgctccaaacagagcaagaacacatcaagaccaagactgccgttgagaatttcctcaagaatggcaccggccagtacctcgacgctgccttgcgcgaatacgcccagacccgccccagctacattgaacagttctggtacgacgcatacttaaactacgactcccccgttgttttaaacttgaatccgtttttcttactcgaagacgacccattcaccaacgagtccagctccgtcaatccccaggttaagcgtgccaccagcttggtgatgtcctcgttgaagttcatccaggcgttgaagaacgagacgttgagcgtcgacaccttgaaaggaggcaagccgttgtgcatgtaccagtacaccaaattgtttggggcgctgcgtatcccctccgaggacgggtgtgtgatgcagagcgacccggcaagtaaccacattgtcgtgatgtctaagtcccagttgtattggtttgacgtgttggatagcaagaacaacttgattttgagcgaagcggagttgaatgtgaacttccagtcgatcattcatgactctttgagaactccctcggatgagattgcaaagagctcgtttggggtgttgacgacggagaatagaagaatttgggctaatgttagacataatttgatgtcgactaccaataataaggttaaccatgaggtgttgtcgattattgactcagcgttgtttgtgttatgctttgatgatatcgtgattaatgacttgtcggagttgtccaagaatatgctttgtgggttgtccattttggataatggtatccaagtgggtacttgtacaaacagatggtatgacaagttgcagattatcgttaccaagaatgccaaagccggtattaatttcgaacatactggtgttgacggtcatacggtgttgagatttgtcagtgatatctacaccgactccatcttgtcctttgccaactccatcaatagcaacgctccatctttatggaacaccactacaaactacaaagaacttgatggggaagatttaatcaccgtgccacgtaagttggaatgggagttgacccctgacttatccttggctttgagatttggagaaaccagattgtcggacttgatcaaccagaacgagttccgccacttggagttcaagaactatgggtctacacaaatcaagaagatgaagttctcaccagatgcgtttgttcaaatggcgttccaagcaacctactatgcgctttacggtaaggttgaatgtacttatgagccagccatgacgaagcagttctaccacggaagaacagaagctataagaaccgtctcgcaagaatcgaacttgtttgtgcgtaagttctttgactccactgtgtccatccagaagaagttagagtacttgacccaagcttgcaccaagcactcccagcaaaccagaatgagttctgccggtcaaggtgtcgatcgtcacttgtatgctttattctgtatctggaagagatacttacacgatgccgaagacgacgatgacgatgcctccaaagaccaaccatcatcgacggaattatcccgtgatgacaccatcattgctcaaaccaacggtgacagcaccgatgatgacgactccaccaccgttgtcggacacggcgccaaccaccatcacaacttgaaaagcgccgatttgttgaaaaccatccctgagatattcgcagacaatggctgggacaagttgaacaacacgatcatatccacctccaactgtggtaatccttctttgagattgtttggatttggtcctgtttcagctaacgggtttggtatcgggtatatcttgaaggacgactcgatctcgatctgtgcttcgtcgaagcatcgtcagacgcagagattcttggtcactttgaactcgtacttgttggagatccagaacatctggaaacaagcgcaaaagatggagaagttgaaggctgagttggctaaagccgtcgaggatgcaaaacctaagggacagaaatcaggtgaagcagaggggatcatcgagcctaagcctaataacttgagcactcttttgggaggttatggttatttcgatatgggcgatgaggacatcaagagcagaggacaatctccagaacctccgttcttgcatcgtgctggatccggtttcagcattcgtgaaataggcaagaagttgagattaagcgagtatcctaagttgtag

SEQ ID NO: 71 - DNA, 855 bp, Candida viswanathii
atggacgacgttgattctgctttagccgataatgttaaatccttcgctgccggtggttttggtggtatttgtgccgtgttgaccggtcatccattcgacttggtcaaggtcagattgcaaactgggttgtacaaatcgtcagtgcaatgtgtcaaagaaacaatagccaaagacgggttgtttgggttatacagaggtgtcttgcctccattgttgggtgtcaccccaatgtttgctgtttccttctggggttacgacgttggtaagaaattggtttcttccttcactggcaaatcagtcgacaagtttgaaatcaaagacatttcgactgccggtttcatcagtgccatcccaaccaccttggttgccgctccattcgaaagagtcaaggtcatgatgcagatccaagaaggtgccaagtccaagtccatgggtgccgttgttgctgaaatgtacagaaccggtggtatcagatccatcttcaagggtactgtggctactttggccagagatggtccaggttctgccttgtatttcgctacttatgaatgggtcaagaaggaattgactgcccctggtgaagacttgtccttgtttgctattaccactgctggtggtttcgctggtattgccatgtggttgggtgttttcccaattgacaccatcaagtctacccagcagtcttccaacgtcaaggtctccattgtgcaggccactaagaacatctacgctaaaggtggtatcaaggctttcttccctggtgttggtcctgccttggccagagctttcccagccaacgctgctaccttcctaggggttgaattggccagaaagttcttggacaaagttatataa

SEQ ID NO: 72 - DNA, 1560 bp, Candida viswanathii
atgtctgccattttgaaacaaagagttagatatgctccatacctcaaaaaattgagaacagcagaacaatgtgtcgacttgttcaagaacggccaatacttgggttggtcgggtttcaccggtgtcggtgccccaaaggctgtcccagccgctttggttgaccacgttgaaaagaacaaattgcagggccaaatgggcttccacttgtttgtcggtgcttctgccggtccagaagaaagcagatgggctgaaaacaacatgcttttatctagatctccacatcaagtcggtaagccaattgctgctgccatcaatgacggcagaactcagttcttcgacaagcacttgtccatgttcccacaagatttgacctacggcttctacaccaagaacaagccaaacggctccaacttggattacaccatcattgaagctaccgccataacagaggatggtgccattatcccaggtcctgccgtcggtgcctccccagaaatgctttcggtttccgacaacatcatcattgaagtcaacacaaaaacaccatccttcgaaggtatacacgacattgacttgccagtcaacccaccattcagacaaccatacccacacaccactgccgactacagaattggcagaaccgccatcccagtcgacccagaaaaggttatcgccattgtcgaaaccacagagggtgacaaggttccaccaaacaccccaagtgacgctcaatcccaagccattgctggtcacttgattgaattcttggaaaacgaagtcaaacaaggtcgtctcccagaaaacttgcacccattacaatccggtatcggtaacattgccaacgctgtcgttgaaggtttggcccaatccaacttcaagaacttgactgtctggaccgaagtcttgcaagattccttcttggacttcttcgaatccggaagtttggactttgcaaccgccacctccatcagattgaccgaggaaggtttcaagaagttctacgaaaactgggacgtctactccaagaagttgtgcttgagatcgcaagttgtctccaactcgccagaaatcatcagaagattgggtgtcttggctttcaacaccccagttgaagttgacatctacgcccacgccaactccaccaacgtcatgggttccagaatgttgaacggtttgggaggctcgggtgatttcttgagaaacgccaagttgtccgtcatgcacaccccatctgctcgtccaaccaaggttgacccaaccggtgtctcttgtattgtcccaatggccacccacgttgatcaaaccgaacacgatctcgatgttgtcgttaccgaacaaggtttggctgatctcagaggtctcagtccaaaggaaagagctcaagttataatcaacaactgtgcccacccagactaccaggctcaattgcaagactactttgacagagctgttttctacgccaccaagaagaagatgttgcacgaaccacacatgttgaacgaagctttcgctatgcacttgaacttgcaagaaaatggtaccatgaagttgaacaaatag

SEQ ID NO: 73 - DNA, 1548 bp, Artificial Sequence
  Description of Artificial Sequence: Synthetic polynucleotide
atggctccatacctcaaaaaattgagaacagcagaacaatgtgtcgacttgttcaagaacggccaatacttgggttggtcgggtttcaccggtgtcggtgccccaaaggctgtcccagccgctttggttgaccacgttgaaaagaacaaattgcagggccaaatgggcttccacttgtttgtcggtgcttctgccggtccagaagaaagcagatgggctgaaaacaacatgcttttatctagatctccacatcaagtcggtaagccaattgctgctgccatcaatgacggcagaactcagttcttcgacaagcacttgtccatgttcccacaagatttgacctacggcttctacaccaagaacaagccaaacggctccaacttggattacaccatcattgaagctaccgccataacagaggatggtgccattatcccaggtcctgccgtcggtgcctccccagaaatgctttcggtttccgacaacatcatcattgaagtcaacacaaaaacaccatccttcgaaggtatacacgacattgacttgccagtcaacccaccattcagacaaccatacccacacaccactgccgactacagaattggcagaaccgccatcccagtcgacccagaaaaggttatcgccattgtcgaaaccacagagggtgacaaggttccaccaaacaccccaagtgacgctcaatcccaagccattgctggtcacttgattgaattcttggaaaacgaagtcaaacaaggtcgtctcccagaaaacttgcacccattacaatccggtatcggtaacattgccaacgctgtcgttgaaggtttggcccaatccaacttcaagaacttgactgtctggaccgaagtcttgcaagattccttcttggacttcttcgaatccggaagtttggactttgcaaccgccacctccatcagattgaccgaggaaggtttcaagaagttctacgaaaactgggacgtctactccaagaagttgtgcttgagatcgcaagttgtctccaactcgccagaaatcatcagaagattgggtgtcttggctttcaacaccccagttgaagttgacatctacgcccacgccaactccaccaacgtcatgggttccagaatgttgaacggtttgggaggctcgggtgatttcttgagaaacgccaagttgtccgtcatgcacaccccatctgctcgtccaaccaaggttgacccaaccggtgtctcttgtattgtcccaatggccacccacgttgatcaaaccgaacacgatctcgatgttgtcgttaccgaacaaggtttggctgatctcagaggtctcagtccaaaggaaagagctcaagttataatcaacaactgtgcccacccagactaccaggctcaattgcaagactactttgacagagctgttttctacgccaccaagaagaagatgttgcacgaaccacacatgttgaacgaagctttcgctatgcacttgaacttgcaagaaaatggtaccatgaagttgaacaaaggtagacgggccaagttgtag

SEQ ID NO: 74 - DNA, 6672 bp, Artificial Sequence
  Description of Artificial Sequence: Synthetic polynucleotide
  modified_base (4079)..(4079): a, c, t, g, unknown or other
atgacagatctttccccaagtccaacagactcccttaattacacacagttgcactcatccttgccatcacatttcttaggtgggaactcggtgctcaccgctgagccttctgccgtgacagatttcgtcaaaacacaccaaggtcacactgttatcaccaaagtcttgattgccaacaacggtattggtgccgtcaaagaaataagatccgtcagaaaatgggcctacgaaacttttggtgacgaaagagctatacagtttgtcgccatggccactcccgaagatatggaggctaacgccgagtacattcgaatggccgaccagtttgtcgaggtcccaggtggtaccaataacaacaactacgcgaatgttgacttgattgtcgaaatcgctgaaagaaccgatgtccacgccgtttgggctggttggggtcatgcctccgaaaaccctttgttgccagraaggttggcagcttcccctaagaagatcgtgtttattggtcctccagggtctgccatgagatctttgggtgacaagatttcttccaccattgttgcacaacacgccaaagtgccatgtatcccatggtctggtactggtgtcgaagaggtccacgtcgacccagaaaccaagttggtgtctgttgacgaccacgtctacgccaaaggttgctgtacctcgccagaagacggtttggaaaaagccaaacgtatcggattcccagttatggttaaggcatccgaaggtggtggtggtaaaggtatcagaaaagtcgaccacgaaaaggacttcatcagtttgtacaaccaggcggctaacgaaataccagggtcaccaattttcatcatgaagttggccggtgacgccagacacttggaagtgcaattgtttgccgatcagtacggtaccaacatttcgcttttcggtagagattgttctgtgcaaagaagacatcaaaagatcattgaagaagctccagtcacaattgccaacaaagacacttttgttgagatggagaaagctgccgtcagattgggtaagttggttggttacgtgtctgccggtaccgttgaatacctttactcctacgccgaagacaagttctactttttggaattgaacccaagattgcaagttgaacatccaactaccgaaatggtttccggtgtcaacttaccagccgctcagttgcaaattgctatgggtctcccaatgcacagaatcagagacatcagattgttgtacggtgttgatccacactctgccactgagattgatttcgagttcaagtccccaaactcattgatcacgcaaagaaagccagctccaaagggtcactgtaccgcttgtcgtatcacttctgaagatccaggtgaagggttcaagccaagtggtggtactcttcacgagttgaacttccgttcttcgtccaatgtctggggttacttctcggtcgccaaccaatcttctatccactcctttgctgattcccagtttggtcacattttcgcctttggtgaaaatcgtcaagcctctagaaagcacatgattgttgccttgaaggaattgagtatcagaggtgactttagaaccactgttgaatacttgatcaagttgttggagactccagatttcgccgacaacaccatcactaccggttggttggatgagttgatcaccaagaagttgactgccgaaagaccagatcctatcgttgctgttgtctgtggtgccgtcaccaaagcccacatccaagccgaagaagacaagaaggagtacattgagtctttggaaaagggtcaagttccaaacaagtccttgttgaaaactatcttcccagttgagtttatctacgaaggtgaaagatacaagtttactgccaccaagtcctccgaagacaagtacactttgttcctcaacggttctagatgtgtcattggtgctcgctcattgtctgatggtggcttgttgtgtgctttggacggtaagtcccactctgtctactggaaggaagaagcagcggccactagattgtctgttgacggtaagacttgcttgttggaagttgaaaacgacccaacccaattgagaactccgtctccaggtaagttggtcaagtacttggttgagagtggtgaacacgttgatgccggccaatcttatgccgaagttgaagtcatgaagatgtgtatgcctttgattgcacaagaaaacggtactgttcaattgctcaaacaaccaggttccactcttaacgctggtgacatcttggcaatcttggcattggacgatccatctaaagttaaacacgccaagccatatgaaggcactttgccagagatgggtgatccaactgttaccggttccaaaccagctcacttgttccaacattacgacaccatcttgaagaacatcttggctggttacgataaccaagtcattttgaactccactttgaagaacatgatggagatcttgaagaacaaggagttgccttattctgaatggagattgcaaatctccgccttgcattcaagaatcccaccaaagttggatgaggctttgacgtccttgattgaaagaaccgaaagcagaggcgccgaattcccagctcgtcagattttgaagctcgtcaacaagactcttggtgaaccaggcaacgaattgttgggcgatgttgttgctcctcttgtctccattgccaaccgctaccagaacggcttggttgaacacgagtacgactactttgcttcattggttaacgagtactgcaatgttgaacacttctttagtggtgaaaacgtgagagaagaagatgttatcttgagattgagagacgagaacaagtctgatttgaagaaggttatcagcatttgcttgtcccactcccgtgtcagtgctaagaacaacttgattttggccatcttggaagcttatgaaccattgttgcaatccaactcttcaactgccgttgccattagagattctttgaagaagatagtccagttggattctcgtgcttgtgccaaggttggtttgaaagctagagaacttttgattcaatgttctttgccatccatcaaggaaagatctgaccaattggaacacattttgagaagtgcagtcgttgagacttcttatggtgaagttttcgccaagcacagagaacctaaattggaaatcatccaagaagttgtcgaatccaagcacgttgttttcgatgtcttgtcgcaatttttggtccaccaagactgctgggttgccattgctgctgccgaagtctatgttagacgttcctacagagcttatgatttgggtaagatcgattaccacattcatgacagattgccaattgttgaatggaagttcaagttggctcaaatcgcaggttccagatacaacgccgtccaatctgccagtgttggtgacgactcgaccactatgaagcatgctgcatctgtttctgacttgtcgtttgttgttgattccaagagcgaatccacttccagaactggtgttttggttccagctagacatttggacgatgttgatgagattctttctgctgcattggagtacttccaaccatctgatgcactctctttccaagctaagggagaaagaccagagttgttgaatgttttgaacattgtcatcaccgacattgacggttactctgacgaagatgaatgcttgaagagaattcatgaaatcttgaacgagtacgaagacgatttggtctttgctggtgttcgtcgtgttacttttgttttcgcccaccaagttggttcttatccaaagtactacaccttcactggtccagtgtatgaagaaaacaaggttatcagacacatcgaaccagctttggctttccaattggaattgggaagattagccaactttgacatcaagccaattttcaccaataacagaaacattcatgtttacgaagctattggtaagaatgctccttcggataagagattcttcactagaggtattattagaggtggtgtcctcaaagatgaaatcagtcttactgagtacttgattgctgaatcgaacagattgatcagtgntatcttggataccttggaagttattgacacttccaactccgatttgaaccacattttcatcaacttctccaacgttttcaacgtccaaccagctgatgttgaagctgcttttgcttcattcttggaaagatttggtagaagattgtggagattgagagttactggtgctgaaatcagaattgtctgtaccgacccacagggcaactcattcccattgcgtgccattatcaataacgtttcaggttatgttgtcaagtcggaattgtacttggaagtgaagaaccctaagggtgattgggtcttcaaatccattggccaccctggctcaatgcacttgcaaccaatctcgactccatacccagtcaaggaatccttgcagccaaaacgttacagagctcacaacatgggaaccacttttgtttacgatttcccagagttgttccgtcaagccaccatttcccaatggaagaagcacggcaagaaggctcctaaagatgtcttcacttctttggagttgatcaccgatgaaaacgatgctttggttgccgttgaaagagatccaggtgccaacaagattggtatggttggtttcaaggtcactgccaagacccctgaatacccacgcggacgttcattcatcattgttgccaatgatatcacccacaagattggttcctttggtccagatgaagatgaatacttcaacaagtgtaccgacttggccagaaagttgggtgttccaagaatttacctttctgccaactccggtgccagaattggtgttgctgaagagttgattccattgtaccaagttgcttggaacgaagaaggtaacccagataaaggtttcagatacttgtacttgaacccagacgccaaagaagctttggaaaaagacggcaagggtgacactattgttactgaacgtattgtcgaagatggtcaagaacgtcacgttatcaaggccattattggtgctgagaacggcttgggtgttgaatgtttgaaaggttccggtttgattgctggtgccacttcaagagcctacagagacatcttcaccattaccttggtcacttgtagatctgttggtattggtgcctatttggtcagattgggtcaaagagctatccaaattgaaggtcaaccaatcattttgactggtgcaccagctatcaacaagttgttgggtagagaagtttactcgtcgaacttgcaattgggtggtacccagatcatgtacaacaatggtgtttcccacttaactgccagtgacgatttggctggtgttgagaagatcatggaatggttgtcctacgttccagctaagcgtggtatgccagtaccaatcttggaaagtgaagatacctgggacagagacattgactactacccaccaaagcaagaagctttcgacatcagatggatgatcgaaggtaagcaagttgaaggtgaagagtttgaatctggtttgtttgacaaaggttcattccaggaaactttatcaggatgggctaaaggtgttgtcgttggtagagctcgtctcggtggtatcccaattggtgtcattggtgttgagaccagaactattgaaaacatgatcccagctgacccagccaacccaagttccactgaagccttgatccaagaagccggtcaagtctggtatccaaactctgcgttcaagaccgcacaagccattaacgacttcaacaacggtgaacaattgccattgatgatcttggccaactggagaggtttctctggtggtcagagagatatgtacaacgaggtcttgaagtacggttccttcattgttgacgctttagttgatttcaagcagccaatcttcacttacatcccaccaaatggtgaattgagaggtggctcttgggtcgttgttgatccaaccatcaactccgacatgatggaaatgtatgccgacgttgactccagagctggtgttttggaaccagaaggtatggttggtatcaaatacagacgggacaagttgttggctaccatgcaaagattggatccaacttatgcccaattgaaggagaagttgaacgactcgagcttgtcgccagaagaacatgcccaagtcagcaccaagattgtcaagcgtgaaaaggcattgttgccaatctatgcccaaatttctgtccagtttgccgacttgcacgacagatccggacgtatgatggctaaaggtgtcattagaaaagaaatcaagtgggttgacgccagacgtttcttcttctggagattgagaagaagattgaacgaagagtacgttttgaagttgattggtgaacaggtcaagaatgccaacaagttggaaaaggttgccaggttgaagagttggatgccaactgttgactacgacgatgaccaagctgtcagtacttggattgaagagaaccacgccaaattgcaaaagagagttgaagaattgagacaggagaagaacaagtccgacattgtcaaattgttgcaagaagacccatcaaacgctgcctctgttatgagggatttcgttgatagattgtccgatgaagaaaaggaaaagttccttaaatcattgaactag

SEQ ID NO: 75 - DNA, 6825 bp, Artificial Sequence
  Description of Artificial Sequence: Synthetic polynucleotide
atgagatgccaagtatctcaaccatcacgatttactaacttgcttgtacatagactcccacgaacactacttaattatccagttgtaaataccctatttattcctagacgtcattattcccttaatttttcattcaagaacctactaaagaaaatgacagatctttccccaagtccaacagactcccttaattacacacagttgcactcatccttgccatcacatttcttaggtgggaactcggtgctcaccgctgagccttctgccgtgacagatttcgtcaaaacacaccaaggtcacactgttatcaccaaagtcttgattgccaacaacggtattggtgccgtcaaagaaataagatccgtcagaaaatgggcctacgaaacttttggtgacgaaagagctatacagtttgtcgccatggccactcccgaagatatggaggctaacgccgagtacattcgaatggccgaccagtttgtcgaggtcccaggtggtaccaataacaacaactacgcgaatgttgacttgattgtcgaaatcgctgaaagaaccgatgtccacgccgtttgggctggttggggtcatgcctccgaaaaccctttgttgccagaaaggttggcagcttcccctaagaagatcgtgtttattggtcctccagggtctgccatgagatctttgggtgacaagatttcttccaccattgttgcacaacacgccaaagtgccatgtatcccatggtctggtactggtgtcgaagaggtccacgtcgacccagaaaccaagttggtgtctgttgacgaccacgtctacgccaaaggttgctgtacctcgccagaagacggtttggaaaaagccaaacgtatcggattcccagttatggttaaggcatccgaaggtggtggtggtaaaggtatcagaaaagtcgaccacgaaaaggacttcatcagtttgtacaaccaggcggctaacgaaataccagggtcaccaattttcatcatgaagttggccggtgacgccagacacttggaagtgcaattgtttgccgatcagtacggtaccaacatttcgcttttcggtagagattgttctgtgcaaagaagacatcaaaagatcattgaagaagctccagtcacaattgccaacaaagacacttttgttgagatggagaaagctgccgtcagattgggtaagttggttggttacgtgtctgccggtaccgttgaatacctttactcctacgccgaagacaagttctactttttggaattgaacccaagattgcaagttgaacatccaactaccgaaatggtttccggtgtcaacttaccagccgctcagttgcaaattgctatgggtctcccaatgcacagaatcagagacatcagattgttgtacggtgttgatccacactctgccactgagattgatttcgagttcaagtccccaaactcattgatcacgcaaagaaagccagctccaaagggtcactgtaccgcttgtcgtatcacttctgaagatccaggtgaagggttcaagccaagtggtggtactcttcacgagttgaacttccgttcttcgtccaatgtctggggttacttctcggtcgccaaccaatcttctatccactcctttgctgattcccagtttggtcacattttcgcctttggtgaaaatcgtcaagcctctagaaagcacatgattgttgccttgaaggaattgagtatcagaggtgactttagaaccactgttgaatacttgatcaagttgttggagactccagatttcgccgacaacaccatcactaccggttggttggatgagttgatcaccaagaagttgactgccgaaagaccagatcctatcgttgctgttgtctgtggtgccgtcaccaaagcccacatccaagccgaagaagacaagaaggagtacattgagtctttggaaaagggtcaagttccaaacaagtccttgttgaaaactatcttcccagttgagtttatctacgaaggtgaaagatacaagtttactgccaccaagtcctccgaagacaagtacactttgttcctcaacggttctagatgtgtcattggtgctcgctcattgtctgatggtggcttgttgtgtgctttggacggtaagtcccactctgtctactggaaggaagaagcagcggccactagattgtctgttgacggtaagacttgcttgttggaagttgaaaacgacccaacccaattgagaactccgtctccaggtaagttggtcaagtacttggttgagagtggtgaacacgttgatgccggccaatcttatgccgaagttgaagtcatgaagatgtgtatgcctttgattgcacaagaaaacggtactgttcaattgctcaaacaaccaggttccactcttaacgctggtgacatcttggcaatcttggcattggacgatccatctaaagttaaacacgccaagccatatgaaggcactttgccagagatgggtgatccaactgttaccggttccaaaccagctcacttgttccaacattacgacaccatcttgaagaacatcttggctggttacgataaccaagtcattttgaactccactttgaagaacatgatggagatcttgaagaacaaggagttgccttattctgaatggagattgcaaatctccgccttgcattcaagaatcccaccaaagttggatgaggctttgacgtccttgattgaaagaaccgaaagcagaggcgccgaattcccagctcgtcagattttgaagctcgtcaacaagactcttggtgaaccaggcaacgaattgttgggcgatgttgttgctcctcttgtctccattgccaaccgctaccagaacggcttggttgaacacgagtacgactactttgcttcattggttaacgagtactgcaatgttgaacacttctttagtggtgaaaacgtgagagaagaagatgttatcttgagattgagagacgagaacaagtctgatttgaagaaggttatcagcatttgcttgtcccactcccgtgtcagtgctaagaacaacttgattttggccatcttggaagcttatgaaccattgttgcaatccaactcttcaactgccgttgccattagagattctttgaagaagatagtccagttggattctcgtgcttgtgccaaggttggtttgaaagctagagaacttttgattcaatgttctttgccatccatcaaggaaagatctgaccaattggaacacattttgagaagtgcagtcgttgagacttcttatggtgaagttttcgccaagcacagagaacctaaattggaaatcatccaagaagttgtcgaatccaagcacgttgttttcgatgtcttgtcgcaatttttggtccaccaagactgctgggttgccattgctgctgccgaagtctatgttagacgttcctacagagcttatgatttgggtaagatcgattaccacattcatgacagattgccaattgttgaatggaagttcaagttggctcaaatcgcaggttccagatacaacgccgtccaatctgccagtgttggtgacgactcgaccactatgaagcatgctgcatctgtttctgacttgtcgtttgttgttgattccaagagcgaatccacttccagaactggtgttttggttccagctagacatttggacgatgttgatgagattctttctgctgcattggagtacttccaaccatctgatgcactctctttccaagctaagggagaaagaccagagttgttgaatgttttgaacattgtcatcaccgacattgacggttactctgacgaagatgaatgcttgaagagaattcatgaaatcttgaacgagtacgaagacgatttggtctttgctggtgttcgtcgtgttacttttgttttcgcccaccaagttggttcttatccaaagtactacaccttcactggtccagtgtatgaagaaaacaaggttatcagacacatcgaaccagctttggctttccaattggaattgggaagattagccaactttgacatcaagccaattttcaccaataacagaaacattcatgtttacgaagctattggtaagaatgctccttcggataagagattcttcactagaggtattattagaggtggtgtcctcaaagatgaaatcagtcttactgagtacttgattgctgaatcgaacagattgatcagtgatatcttggataccttggaagttattgacacttccaactccgatttgaaccacattttcatcaacttctccaacgttttcaacgtccaaccagctgatgttgaagctgcttttgcttcattcttggaaagatttggtagaagattgtggagattgagagttactggtgctgaaatcagaattgtctgtaccgacccacagggcaactcattcccattgcgtgccattatcaataacgtttcaggttatgttgtcaagtcggaattgtacttggaagtgaagaaccctaagggtgattgggtcttcaaatccattggccaccctggctcaatgcacttgcaaccaatctcgactccatacccagtcaaggaatccttgcagccaaaacgttacagagctcacaacatgggaaccacttttgtttacgatttcccagagttgttccgtcaagccaccatttcccaatggaagaagcacggcaagaaggctcctaaagatgtcttcacttctttggagttgatcaccgatgaaaacgatgctttggttgccgttgaaagagatccaggtgccaacaagattggtatggttggtttcaaggtcactgccaagacccctgaatacccacgcggacgttcattcatcattgttgccaatgatatcacccacaagattggttcctttggtccagatgaagatgaatacttcaacaagtgtaccgacttggccagaaagttgggtgttccaagaatttacctttctgccaactccggtgccagaattggtgttgctgaagagttgattccattgtaccaagttgcttggaacgaagaaggtaacccagataaaggtttcagatacttgtacttgaacccagacgccaaagaagctttggaaaaagacggcaagggtgacactattgttactgaacgtattgtcgaagatggtcaagaacgtcacgttatcaaggccattattggtgctgagaacggcttgggtgttgaatgtttgaaaggttccggtttgattgctggtgccacttcaagagcctacagagacatcttcaccattaccttggtcacttgtagatctgttggtattggtgcctatttggtcagattgggtcaaagagctatccaaattgaaggtcaaccaatcattttgactggtgcaccagctatcaacaagttgttgggtagagaagtttactcgtcgaacttgcaattgggtggtacccagatcatgtacaacaatggtgtttcccacttaactgccagtgacgatttggctggtgttgagaagatcatggaatggttgtcctacgttccagctaagcgtggtatgccagtaccaatcttggaaagtgaagatacctgggacagagacattgactactacccaccaaagcaagaagctttcgacatcagatggatgatcgaaggtaagcaagttgaaggtgaagagtttgaatctggtttgtttgacaaaggttcattccaggaaactttatcaggatgggctaaaggtgttgtcgttggtagagctcgtctcggtggtatcccaattggtgtcattggtgttgagaccagaactattgaaaacatgatcccagctgacccagccaacccaagttccactgaagccttgatccaagaagccggtcaagtctggtatccaaactctgcgttcaagaccgcacaagccattaacgacttcaacaacggtgaacaattgccattgatgatcttggccaactggagaggtttctctggtggtcagagagatatgtacaacgaggtcttgaagtacggttccttcattgttgacgctttagttgatttcaagcagccaatcttcacttacatcccaccaaatggtgaattgagaggtggctcttgggtcgttgttgatccaaccatcaactccgacatgatggaaatgtatgccgacgttgactccagagctggtgttttggaaccagaaggtatggttggtatcaaatacagacgggacaagttgttggctaccatgcaaagattggatccaacttatgcccaattgaaggagaagttgaacgactcgagcttgtcgccagaagaacatgcccaagtcagcaccaagattgtcaagcgtgaaaaggcattgttgccaatctatgcccaaatttctgtccagtttgccgacttgcacgacagatccggacgtatgatggctaaaggtgtcattagaaaagaaatcaagtgggttgacgccagacgtttcttcttctggagattgagaagaagattgaacgaagagtacgttttgaagttgattggtgaacaggtcaagaatgccaacaagttggaaaaggttgccaggttgaagagttggatgccaactgttgactacgacgatgaccaagctgtcagtacttggattgaagagaaccacgccaaattgcaaaagagagttgaagaattgagacaggagaagaacaagtccgacattgtcaaattgttgcaagaagacccatcaaacgctgcctctgttatgagggatttcgttgatagattgtccgatgaagaaaaggaaaagttccttaaatcattgaactag

SEQ ID NO: 76 - DNA, 2028 bp, Candida viswanathii
atgccagaatcaactcaacaatctcacatttctttggaccatgaaaagatgcagcaacctccaactggcttcaccgaacgctccaccgcaaagccaaacttggccgactttgacacctacaagaagttgtacaagcagtcggtagaaaacccaaacgagtttttcacagaacaagcaaacaaaaacttggactggttcaaacctttcgacttggccagattccccgtcgatccaaaggacgacttcaagaatggcgacttgcctgcctggttcatcaacggtcagttgaacgcttcttataacgcggttgatagatgggccatcaagaacccagacaagccagctatcatttatgaaggtgacgaaccagacctgggcagaatcatcacttatggcgaattgttgaaagaagtcagtaagttggcccagactttgaccaagttgggtgtcaaaaaaggtgactctgttgctgtctacttgccaatgatccctgaagctatcgtcaccttgttggccattgtcagaatcggtgccgtgcactcggttgtctttgctggtttctcctccgcttccttgagagacagaatcttggatgctgactccagaatcgtcatcactgccgacgagtccaagagaggtggtaagaccattgaaaccaagaagattgtcgatgacgccttgaaggaatgtcctaaggttagaaacgttattgttttcaagagaaccggcaactcccacgttcctttctctgctggtagagacttgtggtggcacgaagaaatggccaaatacggtccatacttcccaccagtgccagtcaactccgaagatccattgttcttgttgtacacttctggttctactggtaagccaaagggtgtccaacacaacaccgccggttacttgttgggcgctatcttgaccaccaagtacacttttgatgtccacgaagaagacgtcttgttcaccgctggtgacgtcggttggatcacgggtcacacctactgtgtctacggcccattgttgtgtggtgccaccaccgttgtctttgaaggtaccccagcttatccaaactactccagatactgggagattgtcgaccaatacaaggtcaaccaattctacgttgccccaaccgctttgagattgttgaagagagccggtaccaagtacgttgaaaaatacgacttgtcctccttgagagtcttgggctctgtcggtgaaccaattgcggccgaggtctggcactggtacaatgacaacattggtagaggcaaggcccacattgtcgatacctactggcaaaccgaatctggttcccacttgttgaccccattggccggtgtcactccaaccaagccaggttccgcttccttgccattctttggtgttgttccaaagatcttggacccaaccaccggtgaagaattagaaggtaacgatgttgaaggtgtccttgccattaaatccgcttggccatccattactagaggtatttacaacgattacaatagatttatcgaaacctacttggccccataccacgaccactacttttccggtgatggtgctgctagagataacgacggcttctactggatcttgggtagagtcgatgatgtcgtcaatgtttccggtcacagattgtcgactgctgaaattgaagctgccttgattgagcacccattggttgctgaatccgctgttgttggttatgctgacgacttgactggtcaagccgtcgctgcctatgtgtccttgaagaaagataaagttattggtgacgacatggaggcagtcaagaaggagttgatcttgactgtcagaaaagaaattggtccatttgctgcaccaaagttgatcttgttggttgacgacttgccaaagaccagatccggtaagatcatgagaagaatcttgagaaaggtcttggctggtgaagaagatcaattgggtgatatctccaccttgtccaacccaggcgttgtccaacaaatcattgaaattgtccatgcctgcaagaaataa

SEQ ID NO: 77 - DNA, 2016 bp, Candida viswanathii
atgactacagactcaaacacccacaaggttgttcacgaagccaatggcgtcaagttgagacaaaccccaaaggaattcttccaaaggcaaccaaacaagggacacatccaagacacggaagagtacaagaaattgtatgagcaatccataaaagacccccaaggtttctttggcccattggctaaagaattgttgtcctgggacagcgatttccacaccgtcaagtcaggtacccttaagaacggtgacgctgcctggttcttgggcggtaagttgaacgcttcttacaactgtgttgccagacacgctttggccaacccaaacaagccagccatcatctacgaagcagatgaagaaagggattcttacatcttgacctacggtgatttgttgagagaagtttccaaagtcgctggtgtcttgcactcctggggcatcagaaagggtgacaccgttgctgtttacttaccaatgaatgcccaagccctcattgccatgttggccattgctagattgggtgctgcccactccgtcatctttgctgggttctcctccggttctatcaaagacagagtcaacgacgccagctgtaaagcgcttattacctgtgatgaaggtagaagaggtggcagaaccaccaacatcaagaagttgtgcgacgaagctttgaagcaatgcccaacggtcaagcacgtcttggtccacagaagaaccggcaacccagaaatcaaattgaccgaaggcagagattactactgggacgaagaaaccgccaagttttccggatacttcccacccgtgccagttgactctgaagacccattgttcttgttgtacacttctggttccactggtactccaaagggtgttgtccacaccaccgccggttacttgttgggtgctgctctttccaccaaatacatctttgacgtccacccagaagatgtcttcttcactgctggtgatgtcggttggatcactggtcacacctacgctttatatggtccattgttgttgggtgttccttctgttgttttcgaaggtactccagcttacccagactacggaagattctggcaaattgttgaaaaacacaaggctacccacttctacgttgctccaactgctttgagattgttgcgtaaagctggtgaacaagaagttggcaagtacgacttgagttcattgagaaccttgggttctgttggtgaaccaatctccccagatatttgggaatggtacaatgaatttgtcggtaaggaccaatgtcatatctcggatacctactggcaaaccgaatccggttctcacttgattgctccattggctggtgccattgccaacaagccaggttctgcttcttacccattctttggtattgaagctgctttgatcgacccagtcactggtgttgaaatcaagggcaacgatgttgaaggtgtgttggttgtcaaggaccactggccatccatggcaagaactgttttcaacaaccacgtcaagtacatggatacctacatgaacccatacccaggctactatttcactggtgatggtgctgccagagataacgacggttactactggatcagaggtagagttgatgatgtcgtcaatgtttctggccacagattgtccaccgccgaaattgaatctgcattgattgaagacccaagagttggtgaatccgctgttgttggtatcaacgatgaccttactggtcaagctgttattgcttacgttgccttgaaatccggcgacgttgctgatgaagacgctttgagaaaggaattgatcttgttggttagaaaagaaattggtccatttgcggctccaaaatctgtcatcttggttcaagacttgcctaagaccagatctggtaagatcatgagaagaatcttgagaaaagtcagttctaacgaagccgatcaattgggtgacatcaccactttgcaaaacccaggttctgttgaaggtatgatttctgccttcggtgctcaattcggtagaaagtaa

SEQ ID NO: 78 - DNA, 1152 bp, Candida viswanathii
atgcttacactaacttctggtcccaaccccttgcctgatttcgaagaagccttgagagtcatcaaagtggacgatacacactatgttggtgcccattcgttgagattgcctgtgaaaggaggacgaggcgtttatggtggccatatgattgcccagtctttgctagtgggtattgaatcaacaagagatgacaagactaataaagtgttcattcctgactcgtaccacctgtactttattggagccggaaatgccaaaatccccatgaactacacggtagagaaactatacgacgatgaaaacgtcagcaagcgtttcatcattgcggaacaaaagggaagacatcgtttgacttgtttggttacattgaggagacccggtaccaagcctttccacgacagcgacaacttggacatcagcatccccgtgcccaagatccagttaaaacaccctgatcccgacaagttgcaccaagttcagcacacggactttattaggaatgcattcggtaaagagcttatggattacagagagtgccctgaagagaacgaactttatgccgcagaaagatggttgactgtgttcaccggtattcgaaaccagcctaaaccgggcgccagtttggaaacggtcgtcgaagaattgccagacgcccagggccagatgcacacagtggagaagagtattttaagacccaaagattcccagtcgttcaaggaccctatctacaactttgtgggtttagccgacttgtctgattcggcattcctcaccaccatggcgagaatcttgcacatcccatgggcgccttccatcgaaatcgacgacacatacgatccagcaagagatgcaacgtatatcatgcgttcaactttgaatgcagcccatatcttccattacaatgcgatgtcattggatcaccatatttatttccacaatgaagattacacttccgacgacggttcaggtttcgacatttgcaaagattggttggctttcacttatcagatgaaaagactctctaataaccgtaccctcgtccgtgggttcttgttcaacgaaaaacacaaatgtatcgccacagtggtgcaagaagggttgactattatgcaaaatggagttggtcgaactgctgataaatcacgtctatag

SEQ ID NO: 79 - DNA, 981 bp, Candida viswanathii
atgattgagaacatttcaggaaacggaaactacccacagaatcacgaggttgacttggagaaggaattcggagttgaaaaaataggtatcaacttgtaccgtggcaagagcccaataccgaagccagacagacgttccagaggtgcttacggtggttacttggccggtcaagctttgttagttgccatgaagtctaccccgccagagtacagaccacacctgttccattcctactttatcaaagctgtcaatgacaaggagacattggagtggagagttgaagaaacatccaacggcagaaactacgccaacagatccttgcaagccttccaagccggtaacttggtctacacagccaacgtctccttgaccaagaaaaactctgccaagaaagctgaggaagcaacgggtgtcaagccctttgagttccagggaaaaccacacgaatggtttgaaaaacacaagagagatgaccttcctcttgctacaccttcttcatcccttttgatctaccacaaattcttcccagaggttgtctcgttggaagcttccaaagaagaagaatcaaagccagcagccgacagagaattgagctggtacttcaaatggggtatcaacaacgaagagggccaccaccagccattagtcaacttgaactccgattaccaatatgttggaatggctgcgttgaccgatgctgtctacttgaacagattattgagaattttgagagttgaagacgctgaccacacccagcttgtccactacttttccgtctccttggaccatactatgtacttccatgacgacgactttgacgtaaccaaatggatgggattcactttcaaggttaccagattcagtcacaaccgtgcattgtgccagggtgaagtttataacgacaagggggtacacgtgtgtacaattgtccaggaagggctcatgatgcttaacggtcttgaacaaggtgctaaattataa

SEQ ID NO: 80 - DNA, 981 bp, Candida viswanathii
atgattgagagcatttcagaaaacggaaactacccacagaaccacgaagttgacttggagaaggaattcggagttgaaaaaataggtatcaacttgtaccgtggcaagagcccaataccgaagccagacagacgttccagaggtgcttacggtggttacttggctggtcaagctttgttagttgccatgaaatctaccccgccagattacagaccacatctgttccattcctactttatcaaagctgtcaatgacaaggtgacattggagtggagagttgaagaaacatccaacggccgaaactacgccaacagagccttgcaagccttccaagccggtgacttggtctacacagctaacgtctccttgaccaagaaaaactccgccaagaaaactgaggaagcaacgggtgtcaagccctttgagttccaggggaagccacacgaatggtttgataagcacaagatagatgaccttcctcttgctacgccttcttcatcccttttgatctaccacaaattcttcccagaggttgtgtcgttggaagcttccaaagaagaggaatcaaagccagcagctgacagagaattgagctggtatttcaaatggggtatcaacaacgaagagggccaccaccagccattagtcaacttgaactctgattaccaatatgttggtatggctgcgttgaccgatgccgtctacttgaacagattattgagaatcttgagagttcaagacgctgaccacacccaacttgtccactacttttccgtctccttggaccacaccatgtacttccatgacgacgactttgatgttaccaaatggatgggattcactttcaaggttaccagattcagtcacaaccgtgcattgtgccaaggtgaagtttacaacgacaagggggtacacgtgtgtacaattgttcaagaaggactcatgatgcttaacggtcttgaagaaggtgctaaattataa

SEQ ID NO: 81 - DNA, 840 bp, Candida viswanathii
atgagtcacccaacgccagaagaagtctacggagtcaccaaagttgccgaaaacaaatacgtggggaacagacccttgaacaagcccacgccgaaaacacgcggagtgtatggcggaaacttctgtgcccaggccatcttggtagccatcgagtcagccccggaagggttcacaccacactccatccacagcaacttcattcgtggcggcgaccccgaagtccctgttgagtgggaggtcgaggtcatctcgaacggcaagtctttcgccaaccgcatagtcaagggcgtgcagcacggcatcgtggtctacgtcgccacggtctcgttgaccaacaagaactcaaccacccgcaacgagagcttcacgtacgacacgcccccggacgagaccgtcaagacgtacggcaacgccgagctagacacatactaccagggctggctctacttggaggtcaagaactaccccaagcagttgcactcgcaccagatctcgtactccgtcaagtgggggccggagaacgacgcgtggaaggacgccagccagacgtaccagtttgttgggctcgctgcgatctccgacgtgcttgacctcggccagatcttgcgcaacttggacatccacttgagcacgcccaagttcaacgtgtcgctcgaccacagtgtgtacttccacggcgcggactttgacgtgaccaggtggtcgacgaccacgatccgcatgacgaagctcgcgcacggccgcgcgttgatagagggcgagatgtactcggaccagggcaggcacatcgccagcatagtgcaagagaggttgtacatagctgagtcgccgaagctctga

SEQ ID NO: 82 - DNA, 897 bp, Candida viswanathii
atgacgctgattgcacccgccacagacatacccgccgtggacatctccaccatatacgacgtcaaacagatcgacgccaaccgctaccgcggcgttcggccgctccagaaacaggcacgcgagttccgcggagtctttggaggcaacttggttgcccagtccgtggtggtggccttgcggtcggtgcccgcaggattccaccccaactccgtccacgcctactacgtgcgtgccgtgaccgacgagacgccaattgagtgggaggtcgaagagacaaccacgggccgcaccttcgccaaccggctgatacgcggattgcagaacaagaaggtggtgttcacggcgagcatctcgttgaccaggaagaactccaatgcggaagtgatccaaaagaccgggcacccgtcgttgcagttccagcgggacaccgagccatactacgagcagatgcgagcccgccctggcgagtgcaaggtgctctacattaacgccaacacgcacctcacggtcagacagttccctgaagtcagctcccgcgacgtgttctcgttcttggtgcggtttggcaacgacgggcgggagaggatcgtggggatgactcccgagtaccagtacgccgcgttggctgcgttgtcggactgggtgaggctccgtttctactttgacaatatgggggtcgacgtgcagacgtcgttcgacgtgtcgttggaccacagcatctacttccacgacgacgggttcgacgctaccgagtacttggttttctccgtcaaggtgtcgcggatcagccacagccgggtgctttacgacgggcagatcttcaacgaccgtggagcccacgttgctagcatcagacaggagcgcttatatgtcgtcagcaacaagccaaagttttag

SEQ ID NO: 83 - DNA, 1062 bp, Candida viswanathii
atgcccacattcaactacaaggacggcgaaacaatagacgtgcagaaagagtttggcgtggtcgagacagcgcccaacaagtacgtcggcgtgaagccactcgtcaagccgatgcctcatgtaaagggagtctttggcggtaaccttgcaggacaagcattgctagtcgccatgaagtcggttggcccagactttagcccacactccttgcattcgtactttatacgcgccggcagcgaccagacacccgtcgagtggactgtgcaggcgatatctgatggtaactcgttttgtaacaggtttatcaagggagtccaaaacggacaggtcatatacattgcgaatgtgtcgttgactaaacgcaactctgctgctgatgcgatgaagaagtacgaggagtaccatgcgcagatccgccagaagggcaaggacggcgatgctgatgaagaggacgaggatgacgatgacgaggatgataatgccccagctaagccatttgggttccagactccgagccataagtggatcaaggaccgcgatctcgacaagttgccagtttccgacatggagtcgaatcttttgttgtactacaagttgcctcccgagttcgtgagcttgaagtcttcaacagaggaagagctgttgccagtctcagagcgcaggatgggtgctttggcgaagtggggtattgagaacgagcaagggttcaaccagcctttgactaatctcgacaagtcgttccagtatgttggtttggccaatatcactgatgggttgtacttgggcacattgaataggatattgcgcattgatgacttgacacttgatgagcgggcgactaactactttagcgtatcattggaccacgtcatctatttccacgatgatgattttgatgtgaccaagtggatgggctttacgttcaggtgttcgagatattcacataatcgggttatttttgaaggtgagatctacagtgacaagggagtccaggttgcatctattattcaagagggcttagttagatttaaagacggctacttgaaaaacgccaagttgtga

SEQ ID NO: 84 - DNA, 1050 bp, Candida viswanathii
atgtcaaccaccggaatctacaacgccaaacccgcggctgccatattggaaacaaaaaccaaggtcaagttagtttatactgaaggaccgaaattggtctacgaaggattgcaccccgttgagaccataaaagaaactgttagaggtacttatggtggtgattttattgctcaaggggtgaacgcagcttgggaatcaattggcaacaggatggattttcaacctcattcattgcacgcatactatataaaaagcggttcccaggagtcagtattacgctgggaagtcttcaaggtgagtgatagcagaagttttgccaaccggatgttaactgcataccagacgcacaccaaccaattggtgttcacgatgcagatatcgttcaccaaagacaacaacgaggagatcaagcgtgcggaatacgaaaagttgttggccagcggtggcaaaatcagaagcatcccatttgtcatcaaaaaggctccgaatgaaaagtatttcaagttacgagacagaatcaatgagcttcattattctgagtataccaatgggatcattgccatggcttccccccttgacttccatgagtatgccactgagatgaactatgacaccttgggaaacaaagagtacgggacgtttatgaaaatcttggataactattccttaggcaaggattattctaaacaatccttcttggggttgtcattcttatccgatggtgtttgggtattttgctttactagagctttggggttgccacttggtagctacgaaaaggagttctttcgtgtcagtttggaccacacggtatatttccacgacgctaatttcgactccagtgagtggctcttcttagattttaggtttgtgaacatgaagaacaacagattcttgactgtgttgaactactatactttgcaaggcaaacttattgcgactgtgctccaagaagtctacacttctttacatcagggtatcattgacaagtcgcaagaaatagctgtcaaaagcggaaataagaagcaggtcacaactccaaagttgtag

SEQ ID NO: 85 - DNA, 1056 bp, Candida viswanathii
atggacaaactacaagctgaagtatacgaggccgaacctcccgtggccaaattggaagccaaaacagcagccaaattgatatcttctgatggggcaaaattgacctacgaaggagtgtaccctgtggagctagtcagaaaaggtctcaggggaacctacgggggagatttcatagcacagggaatcaatgttgcctgggagtcaattggcaataagactgactttcaaccccattcattacatgcatattttgtcaaggcaggatccgacctgtctgtcctacgttgggaagtgctcaaggtgagtgatagcagaaattttgccaaccgtctaatgttagcgtaccagactcacaccaacgaattggtgttcacaatgcagatatcgttcactaaggataacaacgaggagatcaagcgtgccgagtacaagcaattattgcagagtggcggtaaaataagaagtatcccgtttgcaatcaagaaaccacccaatgaaaagtactttaaattgaaagacaaggtggacgatcttccatattttgagcacaccaatgggaatatggcgactgcgattccaccagacttccttgaatacgccacagagatgaatcacgacacggtggggaacaaagagtttggtattttcatgaaagtattggatgattactccttgggcaaaaactatgagagacagtcgttcttggggttggccttcttgtctgatgccgtgtggttatcgagtttcaccccagccttagggttgccattgggcactttagaaaggaaattctttcgtgttagcttagaccacaccatgtatttccatgacgccaactttgattctagtgagtggatctttgtggatttcaggtttgtgaatttgaacaacaacaggctcttgggtgttgtgaacttttacacgttacagggtaagcttgttgctactgtgattcaagaagcgtacatgtttttgcaccaggcgatcatagacaaatcacaagagatagctgaaaaaagcgggcataagaagcaggtgatcaccccgaaattatag

SEQ ID NO: 86 - DNA, 1056 bp, Candida viswanathii
atggacaaattacaagctgaagtatacgacgccgaacctcctgtggccaaattggaagccaaaacagcggccaaattgatatctgctgatggggcgaaattgatctacgaaggagtgtaccctgtggagctagtcagaaaaggtcttaggggaacctacgggggagatttcatagcacaaggaatcaatgttgcctgggagtcgattggcaataagactgactttcaaccccattcattacatgcatattttgtcaaggcagggtccgaccagtctgttttacgttgggaagtgctcaaggtgagtgatagcagaagctttgccaaccgtctaatgttagcatatcagactcacaccaaccaattggtcttcacgatgcagatatcgttcactaaggataacaacgaagaaattaaacgtgctgagtacaagcagctattggagagtggcggtaaaataagaagtatcccgtttgcaatcaagaaaccacccaatgagaagtacttcaaattgaaagacaaagtggacgaccttccatattttgaacataccaatgggaatatggcaactgcaataccacctgatttccttgaatacgccacagagatgaatcacgacacggtggggaacaaagagtttggtattttcatgaaagtattagatgattactccttggataaaaactatgagagacagtcgttcttggggttggccttcttgtctgacgccgtgtggttgtcgagtttcacgccagccttagggttgccattgggcacttttgaaaggaaattctttcgtgttagtttagaccacaccatgtatttccatgacgccaactttgattctagtgagtggatctttgtggatttcaggtttgtgaatttgaacaacaacaggctcttgggtgtggtgaacttttacactttacagggtaagcttgttgctactgtgattcaagaagcgtacatgtttttgcaccaggggatcatagaccaatcacaagagatagctgaaaagagcgggcataagaagcaggtgatcaccccgaaattatag

SEQ ID NO: 87 - DNA, 1056 bp, Candida viswanathii
atggagagattacaggccgaagtctacgacgctaaaccaacagttgctaaattggaaaccaagactaccgtcaaattagttgctcaggacggaaagagattggtttatgaagctatttatccagttgaacatatcaaagaagggattccaggagcttatggaggtgataccttggcccaagggatgaatgctgcgtgggactcccttggcgacaagaaagatttccagcctcattcagttcattcgtactttgttaagcctgcaacaaacaaatcaattttgagatgggaagtgatcaaggtcagtgatggcagaagttttgctaatcgtttcgtgtctggctatcaaacccacaacaatgcgttggtcttcactatgcagatctcctttaccaagtacaacgatgaagtggtcaagattgctgaatacaacaagttgttggaaagtggtggcaaaatcagaagtattccatttgtcatcaagaaagctccgaatgagaagtacttcaaatttaaggacaatcttggagatctcagatacattgagcacaccaatggcaacattgccacagccatgctggaagatttgtttgaatacgccactgagatgaaccatgatactctcggaaatcaagagtttggtattttcatgaaggtcttggataattactcgttaggtagtgactacactaaacaatcttacttggggttggcattcttatcggatgctatttggatgtctgtttgttcaagagccttggggttgccatttggtagctaccatagacaattttttggagttagcatggaccactcgatgtatttccacgacgctaatttcgactccaccgagtggatctttttagactttaggtttgtcaatttgaaaaatgacaggctcttgggcgttgctaatttttacactttagagggtaagcttatttccactttgattcaagaagcttacctctttttacacccaggaatcattgccaagtcccaagagatagctgtcaagagtggaaacaagaggcaagttaaaatgccaaagttgtag

SEQ ID NO: 88 - DNA, 831 bp, Artificial Sequence
  Description of Artificial Sequence: Synthetic polynucleotide
atgagtcacccaacgccagaagaagtctacggagtcaccaaagttgccgaaaacaaatacgtggggaacagacccttgaacaagcccacgccgaaaacacgcggagtgtatggcggaaacttctgtgcccaggccatcttggtagccatcgagtcagccccggaagggttcacaccacactccatccacagcaacttcattcgtggcggcgaccccgaagtccctgttgagtgggaggtcgaggtcatctcgaacggcaagtctttcgccaaccgcatagtcaagggcgtgcagcacggcatcgtggtctacgtcgccacggtctcgttgaccaacaagaactcaaccacccgcaacgagagcttcacgtacgacacgcccccggacgagaccgtcaagacgtacggcaacgccgagctagacacatactaccagggctggctctacttggaggtcaagaactaccccaagcagttgcactcgcaccagatctcgtactccgtcaagtgggggccggagaacgacgcgtggaaggacgccagccagacgtaccagtttgttgggctcgctgcgatctccgacgtgcttgacctcggccagatcttgcgcaacttggacatccacttgagcacgcccaagttcaacgtgtcgctcgaccacagtgtgtacttccacggcgcggactttgacgtgaccaggtggtcgacgaccacgatccgcatgacgaagctcgcgcacggccgcgcgttgatagagggcgagatgtactcggaccagggcaggcacatcgccagcatagtgcaagagaggttgtacatagctgagtcgtaa

SEQ ID NO: 89 - DNA, 696 bp, Candida viswanathii
atggtcgccgattctttagtctaccacccaaccgtctccaaattagtcaagttcttggacacaaccccaaagagggaaaaggtcttcagattattgtcctacttgtccagattcttgggctactacgcctacagaaagggctactccaaggaaaccatcgcccttttcgccaacttgaaaggaaacttcacattcatcagaaaggccatgagattcttgaagccaataaatcacttgcaattggcctccaaggcatacgacaacaagttgttggacccagtcttgcagatcaccaccatcatcagaaacttggcctacgccggctacttgaccatcgacggtgtcatattcttcaagttgttgggtctcattgacgccaagaagttccctaacttggctacatacgcctccagattctggttgatcgggttgattgccggtttgatcaactccttgagaatcatctactccttgaaggactacgagcaccaggagggcgacaaggagaaggagaccgacgctaaggctatccacactaagttgtacgccgctaagagaaaattggtctgggacttgttggatacttttattgctttgaactccttggacatcttgcatttcaccgagggtgacgtcgggttcgctggtactatcacctccctcttgggattggaagacttgtggaaggccacttaa

SEQ ID NO: 90 - DNA, 2040 bp, Candida viswanathii
atggctttagacaagttagatttgtatgtcatcataacattggtggtcgctgtggccgcctattttgctaagaaccagttccttgatcagccccaggacaccgggttcctcaacacggacagcggaagcaactccagagacgtcttgctgacattgaagaagaataataaaaacacgttgttgttgtttgggtcccagaccggtacggcagaagattacgccaacaaattgtcaagagaattgcactccagatttggcttgaaaaccatggttgcagatttcgctgattacgattgggataacttcggagatatcaccgaagatatcttggtgtttttcatcgttgccacctacggtgagggtgaacctaccgacaatgccgacgagttccacacctggttgactgaagaagctgacactttgagtactttgagatataccgtgttcgggttgggtaactccacctacgagttcttcaatgctattggtagaaagtttgacagattgttgagtgagaaaggtggtgacagatttgctgaatatgctgaaggtgacgacggcactggcaccttggacgaagatttcatggcctggaaggataatgtctttgacgccttgaagaatgacttgaactttgaagaaaaggaattgaagtacgaaccaaacgtgaaattgactgagagagatgacttgtctgctgccgactcccaagtttccttgggtgagccaaacaagaagtacatcaactccgagggcatcgacttgaccaagggtccattcgaccacacccacccatacttggccaggatcaccgagaccagagagttgttcagctccaaggaaagacactgtattcacgttgaatttgacatttctgaatcgaacttgaaatacaccaccggtgaccatctagccatctggccatccaactccgacgaaaacatcaagcaatttgccaagtgtttcggattggaagataaactcgacactgttattgaattgaaggcattggactccacttacaccattccattcccaactccaattacttacggtgctgtcattagacaccatttagaaatctccggtccagtctcgagacaattctttttgtcgattgctgggtttgctcctgatgaagaaacaaagaagactttcaccagacttggtggtgacaaacaagaattcgccaccaaggttacccgcagaaagttcaacattgccgatgccttgttatattcctccaacaacactccatggtccgatgttccttttgagttccttattgaaaacatccaacacttgactccacgttactactccatttcttcttcgtcgttgagtgaaaaacaactcatcaatgttactgcagtcgttgaggccgaagaagaagccgatggcagaccagtcactggtgttgttaccaacttgttgaagaacattgaaattgcgcaaaacaagactggcgaaaagccacttgttcactacgatttgagcggcccaagaggcaagttcaacaagttcaagttgccagtgcacgtgagaagatccaactttaagttgccaaagaactccaccaccccagttatcttgattggtccaggtactggtgttgccccattgagaggtttcgttagagaaagagttcaacaagtcaagaatggtgtcaatgttggcaagactttgttgttttatggttgcagaaactccaacgaggactttttgtacaagcaagaatgggccgagtacgcttctgttttgggtgaaaactttgagatgttcaatgccttctctagacaagacccatccaagaaggtttacgtccaggataagattttagaaaacagccaacttgtgcacgaattgttgaccgaaggtgccattatctacgtctgtggtgacgccagtagaatggccagagacgtccagaccacgatctccaagattgttgccaaaagcagagaaatcagtgaagacaaggccgctgaattggtcaagtcctggaaagtccaaaatagataccaagaagatgtttggtag

SEQ ID NO: 91 - DNA, 2091 bp, Candida viswanathii
atgggtgcccctttaacagtcgccgttggcgaagcaaaaccaggcgaaaccgctccaagaagaaaagccgctcaaaaaatggcctctgtcgaacgcccaacagactcaaaggcaaccactttgccagacttcattgaagagtgttttgccagaaacggcaccagagatgccatggcctggagagacttggtcgaaatccacgtcgaaaccaaacaggttaccaaaatcattgacggcgaacagaaaaaggtcgataaggactggatctactacgaaatgggtccttacaactacatatcctaccccaagttgttgacgttggtcaagaactactccaagggtttgttggagttgggcttggccccagatcaagaatccaagttgatgatctttgccagtacctcccacaagtggatgcagaccttcttagcctccagtttccaaggtatccccgttgtcaccgcctacgacaccttgggtgagtcgggcttgacccactccttggtgcaaaccgaatccgatgccgtgttcaccgacaaccaattgttgtcctccttgattcgtcctttggagaaggccacctccgtcaagtatgtcatccacggggaaaagattgaccctaacgacaagagacagggcggcaaaatctaccaggatgcggaaaaggccaaggagaagattttacaaattagaccagatattaaatttatttctttcgacgaggttgttgcattgggtgaacaatcgtccaaagaattgcatttcccaaaaccagaagacccaatctgtatcatgtacacctcgggttccaccggtgctccaaagggtgtggttatcaccaatgccaacattgttgccgccgtgggtggtatctccaccaatgctactagagacttggttagaactgtcgacagagtgattgcatttttgccattggcccacattttcgagttggcctttgagttggttaccttctggtggggggctccattgggttacgccaatgtcaagactttgaccgaagcctcctgcagaaactgtcagccagacttgattgaattcaaaccaaccatcatggttggtgttgctgccgtttgggaatcggtcagaaagggtgtcttgtctaaattgaaacaggcttctccaatccaacaaaagatcttctgggctgcattcaatgccaagtctactttgaaccgttatggcttgccaggcggtgggttgtttgacgctgtcttcaagaaggttaaagccgccactggtggccaattgcgttatgtgttgaatggtgggtccccaatctctgttgatgcccaagtgtttatctccaccttgcttgcgccaatgttgttgggttacggtttgactgaaacctgtgccaataccaccattgtcgaacacacgcgcttccagattggtactttgggtaccttggttggatctgtcactgccaagttggttgatgttgctgatgctggatactacgccaagaacaaccagggtgaaatctggttgaaaggcggtccagttgtcaaggaatactacaagaacgaagaagaaaccaaggctgcattcaccgaagatggctggttcaagactggtgatattggtgaatggaccgccgacggtggtttgaacatcattgaccgtaagaagaacttggtcaagactttgaatggtgaatacattgctttggagaaattggaaagtatttacagatccaaccacttgattttgaacttgtgtgtttacgctgaccaaaccaaggtcaagccaattgctattgtcttgccaattgaagccaacttgaagtctatgttgaaggacgaaaagattatcccagatgctgattcacaagaattgagcagcttggttcacaacaagaaggttgcccaagctgtcttgagacacttgctccaaaccggtaaacaacaaggtttgaaaggtattgaattgttgcagaatgttgtcttgttggatgacgagtggaccccacagaatggttttgttacttctgcccaaaagttgcagagaaagaagattttagaaagttgtaaaaaagaagttgaagaggcatacaagtcgtcttag

SEQ ID NO: 92 - DNA, 1989 bp, Candida viswanathii
atgcctaccgaacttcaaaaagaaagagaactcaccaagttcaacccaaaggagttgaactacttcttggaaggttcccaagaaagatccgagatcatcagcaacatggtcgaacaaatgcaaaaagaccctatcttgaaggtcgacgcttcatactacaacttgaccaaagaccaacaaagagaagtcaccgccaagaagattgccagactctccagatactttgagcacgagtacccagaccaacaggcccagagattgtcgatcctcggtgtctttgacccacaagtcttcaccagaatcggtgtcaacttgggtttgtttgtttcctgtgtccgtggtaacggtaccaactcccagttcttctactggaccataaataagggtatcgacaagttgagaggtatctatggttgttttggtatgactgagttggcccacggttccaacgtccaaggtattgaaaccaccgccacttttgacgaagacactgacgagtttgtcatcaacaccccacacattggtgccaccaagtggtggatcggtggtgctgcgcactccgccacccactgctccgtctacgccagattgaaggtcaaaggaaaggactacggtgtcaagacctttgttgtcccattgagagactccaaccacgacctcgagccaggtgtgactgttggtgacattggtgccaagatgggtagagacggtatcgataacggttggatccagttctccaacgtcagaatcccaagattctttatgttgcaaaagtactgtaaggtttcccgtctgggtgaagtcaccatgccaccatctgaacaattgtcttactcggctttgattggtggtagagtcaccatgatgatggactcctacagaatgaccagtagattcatcaccattgccttgagatacgccatccacagaagacaattcaagaagaaggacaccgataccattgaaaccaagttgattgactacccattgcatcaaaagagattgttcccattcttggctgccgcttacttgttctcccaaggtgccttgtacttagaacaaaccatgaacgcaaccaacgacaagttggacgaagctgtcagtgctggtgaaaaggaagccattgacgctgccattgtcgaatccaagaaattgttcgtcgcttccggttgtttgaagtccacctgtacctggttgactgctgaagccattgacgaagctcgtcaagcttgtggtggtcacggttactcgtcttacaacggtttcggtaaagcctactccgactgggttgtccaatgtacctgggaaggtgacaacaacatcttggccatgaacgttgccaagccaatggttagagacttgttgaaggagccagaacaaaagggattggttctctccagcgttgccgacttggacgacccagccaagttggttaaggctttcgaccacgccctttccggcttggccagagacattggtgctgttgctgaagacaagggtttcgacattaccggtccaagtttggttttggtttccaagttgaacgctcacagattcttgattgacggtttcttcaagcgtatcaccccagaatggtctgaagtcttgagacctttgggtttcttgtatgccgactggatcttgaccaactttggtgccaccttcttgcagtacggtatcattaccccagatgtcagcagaaagatttcctccgagcacttcccagccttgtgtgccaaggttagaccaaacgttgttggtttgactgatggtttcaacttgactgacatgatgaccaatgctgctattggtagatatgatggtaacgtctacgaacactacttcgaaactgtcaaggctttgaacccaccagaaaacaccaaggctccatactccaaggctttggaagacatgttgaaccgtccagaccttgaagtcagagaaagaggtgaaaagtccgaagaagctgctgaaatcttgtccagttaa

SEQ ID NO: 93 - DNA, 2130 bp, Candida viswanathii
atgacttttacaaagaaaaacgttagtgtatcacaaggtcctgaccctagatcatccatccaaaaggaaagagacagctccaaatggaaccctcaacaaatgaactacttcttggaaggctccgtcgaaagaagtgagttgatgaaggctttggcccaacaaatggaaagagacccaatcttgttcacagacggctcctactacgacttgaccaaggaccaacaaagagaattgaccgccgtcaagatcaacagaatcgccagatacagagaacaagaatccatcgacactttcaacaagagattgtccttgattggtatctttgacccacaggtcggtaccagaattggtgtcaacctcggtttgttcctttcttgtatcagaggtaacggtaccacttcccaattgaactactgggctaacgaaaaggaaaccgctgacgttaaaggtatctacggttgtttcggtatgaccgaattggcccacggttccaacgttgctggtttggaaaccaccgccacatttgacaaggaatctgacgagtttgtcatcaacaccccacacattggtgccaccaagtggtggattggtggtgctgctcactccgccacccactgttctgtctacgccagattgattgttgacggtcaagattacggtgtcaagacttttgttgtcccattgagagactccaaccacgacctcatgccaggtgtcactgttggtgacattggtgccaagatgggtagagatggtatcgataacggttggatccaattctccaacgtcagaatcccaagattctttatgttgcaaaagttctgtaaggtttctgctgaaggtgaagtcaccttgccacctttggaacaattgtcttactccgccttgttgggtggtagagtcatgatggttttggactcctacagaatgttggctagaatgtccaccattgccttgagatacgccattggtagaagacaattcaagggtgacaatgtcgatccaaaagatccaaacgctttggaaacccaattgatagattacccattgcaccaaaagagattgttcccatacttggctgctgcctacgtcatctccgctggtgccctcaaggttgaagacaccatccataacaccttggctgaattggacgctgccgttgaaaagaacgacaccaaggctatctttaagtctattgacgacatgaagtcattgtttgttgactctggttccttgaagtccactgccacttggttgggtgctgaagccattgaccaatgtagacaagcctgtggtggtcacggttactcgtcctacaacggcttcggtaaagcctacaacgattgggttgtccaatgtacttgggaaggtgacaacaatgtcttggccatgagtgttggtaagccaattgtcaagcaagttatcagcattgaagatgccggcaagaccgtcagaggttccaccgctttcttgaaccaattgaaggactacactggttccaacagctccaaggttgttttgaacactgttgctgacttggacgacatcaagactgtcatcaaggctattgaagttgccatcatcagattgtcccaagaagctgcttctattgtcaagaaggaatctttcgactatgtcggcgctgaattggttcaactctccaagttgaaggctcaccactacttgttgactgaatacatcagaagaattgacacctttgaccaaaaggacttggttccatacttgatcaccctcggtaagttgtacgctgccactattgtcttggacagatttgccggtgtcttcttgactttcaacgttgcctccaccgaagccatcactgctttggcctctgtgcaaattccaaagttgtgtgctgaagtcagaccaaacgttgttgcttacaccgactccttccaacaatccgacatgattgtcaattctgctattggtagatacgatggtgacatctatgagaactactttgacttggtcaagttgcagaacccaccatccaagaccaaggctccttactctgatgctttggaagccatgttgaacagaccaaccttggacgaaagagaaagatttgaaaagtctgatgaaaccgctgctatcttgtccaagtaa

SEQ ID NO: 94 - DNA, 2208 bp, Candida viswanathii
atggtcaacatatcgaaattgacgggttataacaagcaggacatcaggaatgtggtgctattgctacaggagtttgtcaagacctacaaagacaacaagatcaaactcaactacctgagtagacctgtcatcttgttcttgagtaccttggttgcaactgccggtattggggtgtttttcaccttgagaagcatcgtcactaagtacaacgagtacctactcaacaagagattgagacgcccaagtcttatcagacaatcctccaatatcttgaagaacggatcccgtgagatctttatccagaagggcaacggcaaagtaacaagaatcatcatcccaaaagcaaacaacgaccagtatgccgccgacaagtatttgtataaagattttgcccgcaacgagcaaatattgcaacagcaaaagggaaggctcttcaattccagattcttgaaccagttgaccattatctggaagatcttgattccaaagttctactgccaaaacacttccttgttgttatcgcagtgcttctttttgattttcagaacatggttgtccttgttgattgccaagctagatggtcagattgtcaagaacttgattgctgcagacggtaggaagtttgcccgtgacttgatttactttttgttgattgccttccctgcttcgtacaccaacgccgctatcaaatacttggaattgagattggcgttaggattcagaactaatcttaccagatacatccatgacatgtacttggacaaaaccatgtcgtactacaaagtgggattgaacggcgccgatatccaaaacatagaccagtacatcaccgaagatgtcaccaaattctgtatgtcgttgtgttcgttgttttcctccatgggtaagccattcattgacttgatctttttcagtgtttatttgagagacaatttgggtactggtgccattattggcatttttgccaactattttgctaccgccatcatgttgaaaaaggcaacaccaagattcggtaagttggctgccaaaagaacccacttggaaggtgtttatttcaaccaacagttgaacataatgaccaacagtgaagagattgggttctacaaaggatcgaagattgagaagtccaagcttgcggagaactttgacaagttgatgggtcacgtatcgagagaaatcaatttatcgtccagctatgccgctctagaagactacgtgcttaaatacacgtggctggcctggggttacatcttttctggtctacctgtgtttttggatgtgcttttccctaaagaagacccaagtagtggccatattgctgatatagatgacgatgaccatgcccatggacacgggcacaccggggaagagaccagctcaacaactgaaaacatgaagaccttcgtcaccaacaagcgattattgttgagtcttgccgatgctggttccagattgatggttagtttgaaagaggtcaccacgttgacaggtataacgaatagagtcttcaacatgttgactcagctccaccgtgtccatgatcctaaatttgactacggtgacaagtatggtttgcctgatattcacgggacttatcaattgaactacgatggtttgagattggaacatgttccaattactgtgccaactgccgagggttcttactccacaccattgatcccagacctcacttttgacatcaagggcaagaatttgttatttgttggtccaaacggttcgggcaaaacttctgttgccagggttcttgcaggtctttggcccttgtatgccgggttagtgctgaaaccactggatttgttctttaacccacaaaagagttatttcaccaccggaagtttgcgtgaccaagttgtttaccctaatagatccgaaaacaccaccaacgatcaaattttccacatcttacactgtgtacacttagaccatattgttaaacggtacggattgaaccagaacttggatttcgctaaaacattgagtggaggtgagaagcaaagattgagtttcgccagagtgttgtttaacagaccaagtattgtcattcttgatgattcgacgtcggcgttgtccccagatatggaagagttgatgtaccaggtgttgcaagatcacaagatcaattacgtcacactttcaaatcgtccctctctcagtaagttccatgataaagtatttgaaatataa

SEQ ID NO: 95 - DNA, 1998 bp, Candida viswanathii
atgacagtggagaatgcaaaactacagaagaactcgttggcggttctgctcttgaaggtgtacaaatccaacagatcattattgttaaacacctcatacatcatattaatcattgctgccttcactggcgcaacgaataccgggcgaggcacctcctccagatcatcggcaaaagtagagaccgatgaagaacaatcggttaaaaagaaacaccccaagctctctagagagtccttccatagactaagaaaagcaatcttgccaactttctttgatagaactatagtttactttttcgccaacttgactttgttggtggtcagagcattattgacacttagagttgctacccttgacggtcagcttgtgggggcattggtttcaagaagaataagggtgtttgccaagtacttgttgtactggatgcttcttggtatccccgctgctttgacaaatgccttgttgaactggaccaaactgaacttgagcaagagcattagaatgaacttgaataataacatcatggaggaatacttgccagataacttggacccaaactattattcattgatccatttgactgataacaagattagagacccaaatcagagaataaccactgatactagtcgtttgagcgatgccttggcaagcttgcccggtcacatattgaagccaacgttggatatcatattgtgtgcgcaacagttaagcaagagcggtgttggtaatggggaaggtacgttggcattaggtatattggcacacttctcaaccatgatcatccgtttcttctccccgccatttgccaagttggcggctgagagagctaaccttgaaggtcagttgcgttccgcgcattccaagattgttgccaacagtgaagaaattgctttcttgggtggtcatgaccgtgagttggatcacatcgaccactgctactatactttggagagattctcgaaaggcgaatattggaagcgagccatacacgaaatcacacaaacgtttattgtgaagtacttttggggtgttgcaggtttagtgttgtgttctgcaccggttttcattgccaaatacttgggtgagccggaagataagaatgttgctggtaatttcatcaccaacagaagattgttgatgagtgcctcggattccttggatcgtttaatctattctagaagatacttgttgcaagttgtcggtcatgctaccagagtgtctgacttcttggacactttacatgaagtggaggagaagaagaagagaatcacatcgaatgtgcagtttaacaacgacgagattactttcgatcatgttagattgatgactccaacggaagtgaccttgatcccagacttgaacttttccattaaaccaggtgaccatttgttgattgtggggccaaacggttcaggtaagtcgtcgttgttcagaatgttgggtgggttgtggcccgttaggtttggtactattagaattccaaacacagagaacatgttctacttgccgcaaaaggcttaccttgttgaaggatcattcagagagcaaatcatttatccacacaacgtgactcaacagaagaagactgatcaacaattgaaagagatcttgaaggttttgaaattggaagattactcagggcaattggatgaggttaagaaatggagcgaagaattgtccattggtgctcaacaaagattggctatggctagattgtactaccacgaacctaagtttgctgtcttggacgaatgtacttcagctgtgtcaccagacatggaacaactcatgtaccaacacgcacaaggtttgggtatcacgcttttgtccgttgcccatagacctgcattgtggcacttccacaaatacttgttggaattcgacgggaagggtagttactactttggtacgttggatgaaaagcacaaaatgaagttagaagaagaagaacgactcaagaaggagaatgaaaagaagagtgtcgccaagaagtag

SEQ ID NO: 96 - DNA, 1953 bp, Artificial Sequence
  Description of Artificial Sequence: Synthetic polynucleotide
atgtccgccaacgaaaacatctccagattcgacgcccctgtcggtaaggaacacccagcctacgaattattccataaccacacaagatccttcgtttatggattacaacctagagcctgtcaaggaatgttggacttcgacttcatctgcaagagagaaaacccatctgtcgccggagttatctatccattcggtggtcaattcgttaccaagatgtactggggtaccaaggaaactcttttacctgtttaccaacaagttgaaaaggccgctgccaagcacccagaagttgatgttgtcgttaactttgcctcttccagatctgtttactcttccaccatggaattgttagaatacccacaattcagaaccatcgccattattgccgaaggagttccagaaagaagggccagagaaatcttacacaaggcccaaaagaagggagtcaccatcattggaccagctaccgttggcggaatcaagccaggatgtttcaaggtgggcaacaccggcggaatgatggacaacattgttgcctctaagttatacagaccaggttctgtggcctacgtttctaagtctggcggcatgtctaacgaattgaacaacattatctcccacaccaccgacggagtttacgaaggaattgctattggaggagacagataccctggaactaccttcattgaccatatcttgagatacgaagccgacccaaagtgcaagatcatcgttttacttggagaagtgggaggagtggaagaatacagagttatcgaagctgtgaagaacggtcaaatcaagaagccaatcgttgcttgggccattggaacttgcgcctctatgttcaagactgaagtgcaattcggtcacgccggttctatggccaactctgacttggaaactgccaaggctaagaacgccgccatgaagtccgctggtttctacgttccagataccttcgaagacatgccagaagttcttgccgaattatacgaaaagatggttgccaagggtgaattgtccagaatctccgaacctgaagttccaaagatcccaattgactactcctgggcccaagaacttggacttatcagaaagccagctgctttcatctctactatttctgatgacagaggtcaagaacttttgtacgctggtatgccaatttctgaagtgttcaaggaagacattggaatcggtggagttatgtccttgttgtggttcagaagaagattaccagactacgcctctaagtttcttgaaatggtgttaatgcttactgctgaccacggaccagccgtatctggagccatgaacaccattatcaccaccagagctggaaaggatttaatttcctctttggtggctggattattgaccattggaaccagattcggcggagctcttgacggagctgccaccgaattcaccactgcctacgacaagggattgtctccaagacaattcgtggataccatgagaaagcaaaacaagttgattcctggaattggtcatagagttaagtccagaaacaacccagatttcagagttgaacttgttaaggactttgtgaagaagaacttcccatctacccaattgttagactacgcccttgctgttgaagaagttaccacctctaagaaggacaacttgattttgaacgtggacggagctattgctgtgtcctttgttgatttaatgagatcctgtggagcctttactgtcgaagaaactgaagactacttaaagaacggagtgttaaacggattgttcgtgttaggaagatctattggattaattgcccaccatttagatcaaaagagattaaagaccggattgtacagacatccttgggacgatatcacctacttggtgggtcaagaagctatccaaaagaagagagttgaaatcagtgccggtgacgtgtctaaggccaagactagatcatag

SEQ ID NO: 97 - DNA, 1494 bp, Artificial Sequence
  Description of Artificial Sequence: Synthetic polynucleotide
atgtcagcgaaatctattcacgaagccgacggtaaggccttgttagcacactttttgtctaaggcgccagtctgggccgaacaacaaccaatcaacacgtttgagatgggtacaccaaagttggcgtccttgacgttcgaagacggtgtcgccccagaacaaatcttcgccgccgctgagaagacctacccatggttgttggaatctggtgccaagtttgtcgccaagccagaccaattaatcaagagaagaggtaaggccggtttgttggtattaaacaagtcgtgggaagaatgtaagccatggatcgccgaacgtgccgccaagccaatcaacgtcgaaggtattgacggcgtcttgagaacgttcttggttgaaccatttgtcccacacgaccaaaagcacgaatactacatcaacatccactctgtcagagaaggtgactggatcttattctaccacgaaggcggcgttgacgttggtgacgtcgacgccaaggccgccaagatcttaatcccagtggacattgaaaacgaatacccatctaacgccacgttaaccaaggaattgttggcacacgtcccagaagaccaacaccaaaccttgttagacttcatcaaccgtttatacgccgtttacgttgatttgcaatttacgtatttggaaatcaacccattggttgtcatcccaaccgcccaaggtgttgaagttcactacttggatcttgccggtaagttagaccaaaccgcagaatttgaatgtggtccaaagtgggctgctgcgcgttctccagccgctttgggtcaagttgttaccattgacgccggttctaccaaggtctctatcgacgccggtccagccatggttttcccagctcctttcggaagagaattgtctaaggaagaagcgtacattgcggaattagattctaagaccggcgcttccttgaagttgactgtgttaaatgccaagggtagaatctggacccttgtcgctggaggcggcgcctctgttgtttacgccgacgccattgcgtccgccggttttgctgacgaattagccaactacggtgaatactccggtgctccaaacgaaacccaaacctacgaatacgccaaaaccgtattggatttaatgacccgtggtgacgctcacccagaaggtaaggtattgttcattggtggcggcatcgccaacttcacccaagtgggctctaccttcaagggtatcatccgtgccttccgtgactaccaatcctccttgcacaaccacaaggtcaagatttacgtcagaagaggtggaccaaactggcaagaaggattgcgtctcatcaagtcggctggtgacgaattgaatttgccaatggaaatttacggtccagacatgcacgtctcgggaattgtgcctctcgctttgcttggcaagcgtccaaagaatgttaagccttttggtaccggcccttccactgaagcttctactcctttaggcgtgtaa

SEQ ID NO: 98 - DNA, 1953 bp, Candida viswanathii
atgtcaggattagaaatagccgctgctgccatccttggtagtcagttattggaagccaaatatttaattgccgacgacgtgctgttagccaagacagtcgctgtcaatgccctcccatacttgtggaaagccagcagaggtaaggcatcatactggtactttttcgagcagtccgtgttcaagaacccaaacaacaaagcgttggcgttcccaagaccaagaaagaatgcccccacccccaagaccgacgccgagggattccagatctacgacgatcagtttgacctagaagaatacacctacaaggaattgtacgacatggttttgaagtactcatacatcttgaagaacgagtacggcgtcactgccaacgacaccatcggtgtttcttgtatgaacaagccgcttttcattgtcttgtggttggcattgtggaacattggtgccttgcctgcgttcttgaacttcaacaccaaggacaagccattgatccactgtcttaagattgtcaacgcttcgcaagttttcgttgacccggactgtgattccccaatcagagataccgaggctcagatcagagaggaattgccacatgtgcaaataaactacattgacgagtttgccttgtttgacagattgagactcaagtcgactccaaaacacagagccgaggacaagaccagaagaccaaccgatactgactcctccgcttgtgcattgatttacacctcgggtaccaccggtttgccaaaagccggtatcatgtcctggagaaaagccttcatggcctcggttttctttggccacatcatgaagattgactcgaaatcgaacgtcttgaccgccatgcccttgtaccactccaccgcggccatgttggggttgtgtcctactttgattgtcggtggctgtgtctccgtgtcccagaaattctccgctacttcgttctggacccaggccagattatgtggtgccacccacgtgcaatacgtcggtgaggtctgtcgttacttgttgaactccaagcctcatccagaccaagacagacacaatgtcagaattgcctacggtaacgggttgcgtccagatatatggtctgagttcaagcgcagattccacattgaaggtatcggtgagttctacgccgccaccgagtcccctatcgccaccaccaacttgcagtacggtgagtacggtgtcggcgcctgtcgtaagtacgggtccctcatcagcttgttattgtctacccagcagaaattggccaagatggacccagaagacgagagtgaaatctacaaggaccccaagaccgggttctgtaccgaggccgcttacaacgagccaggtgagttgttgatgagaatcttgaaccctaacgacgtgcagaaatccttccagggttattatggtaacaagtccgccaccaacagcaaaatcctcaccaatgttttcaaaaaaggtgacgcgtggtacagatccggtgacttgttgaagatggacgaggacaaattgttgtactttgtcgacagattaggtgacactttccgttggaagtccgaaaacgtctccgccaccgaggtcgagaacgaattgatgggctccaaggccttgaagcagtccgtcgttgtcggtgtcaaggtgccaaaccacgaaggtagagcctgttttgccgtctgtgaagccaaggacgagttgagccatgaagaaatcttgaaattgattcactctcacgtgaccaagtctttgcctgtgtatgctcaacctgcgttcatcaagattggcaccattgaggcttcgcacaaccacaaggttcctaagaaccaattcaagaaccaaaagttgccaaagggtgaagacggcaaggatttgatctactggttgaatggcgacaagtaccaggagttgactgaagacgattggtctttgatttgtaccggtaaagccaaattgtag

SEQ ID NO: 99 - DNA, 1554 bp, Artificial Sequence
  Description of Artificial Sequence: Synthetic polynucleotide
atgattgaacaactcctagaatattggtatgtcgttgtgccagtgttgtacatcatcaaacaactccttgcatacacaaagactcgcgtcttgatgaaaaagttgggtgctgctccagtcacaaacaagttgtacgacaacgctttcggtatcgtcaatggatggaaggctctccagttcaagaaagagggcagggctcaagagtacaacgattacaagtttgaccactccaagaacccaagcgtgggcacctacgtcagtattcttttcggcaccaggatcgtcgtgaccaaagatccagagaatatcaaagctattttggcaacccagtttggtgatttttctttgggcaagaggcacactctttttaagcctttgttaggtgatgggatcttcacattggacggcgaaggctggaagcacagcagagccatgttgagaccacagtttgccagagaacaagttgctcatgtgacgtcgttggaaccacacttccagttgttgaagaagcatattcttaagcacaagggtgaatactttgatatccaggaattgttctttagatttaccgttgattcggccacggagttcttatttggtgagtccgtgcactccttaaaggacgaatctattggtatcaaccaagacgatatagattttgctggtagaaaggactttgctgagtcgttcaacaaagcccaggaatacttggctattagaaccttggtgcagacgttctactggttggtcaacaacaaggagtttagagactgtaccaagctggtgcacaagttcaccaactactatgttcagaaagctttggatgctagcccagaagagcttgaaaagcaaagtgggtatgtgttcttgtacgagcttgtcaagcagacaagagaccccaatgtgttgcgtgaccagtctttgaacatcttgttggccggaagagacaccactgctgggttgttgtcgtttgctgtctttgagttggccagacacccagagatctgggccaagttgagagaggaaattgaacaacagtttggtcttggagaagactctcgtgttgaagagattacctttgagagcttgaagagatgtgagtacttgaaagcgttccttaatgaaaccttgcgtatttacccaagtgtcccaagaaacttcagaatcgccaccaagaacacgacattgccaaggggcggtggttcagacggtacctcgccaatcttgatccaaaagggagaagctgtgtcgtatggtatcaactctactcatttggaccctgtctattacggccctgatgctgctgagttcagaccagagagatggtttgagccatcaaccaaaaagctcggctgggcttacttgccattcaacggtggtccaagaatctgtttgggtcagcagtttgccttgacggaagctggctatgtgttggttagattggtgcaagagttctcccacgttaggctggacccagacgaggtgtacccgccaaagaggttgaccaacttgaccatgtgtttgcaggatggtgctattgtcaagtttgactag

SEQ ID NO: 100 - DNA, 1050 bp, Candida viswanathii
atgtctgctaatatcccaaaaactcaaaaagctgtcgtcttcgagaagaacggtggtgaattaaaatacaaagacatcccagtgccaaccccaaaggccaacgaattgctcatcaacgtcaagtactcgggtgtctgtcacactgatttgcacgcctggaagggtgactggccattggacaccaaattgccattggttggtggtcacgaaggtgctggtgttgttgtcggcatgggtgaaaacgtcaagggctggaaaatcggtgatttcgccggtatcaaatggttgaacggttcttgtatgtcctgtgagttctgtcagcaaggtgctgaaccaaactgtggtgaagctgacttgtctggttacacccacgatggttctttcgaacaatacgccactgctgatgctgtgcaagccgccagaatcccagctggcactgatttggccgaagttgccccaatcttgtgtgctggtgtcaccgtctacaaagccttgaagactgccgacttggctgctggtcaatgggtcgctatctccggtgctggtggtggtttgggctccttggctgtccaatacgccgtcgccatgggtttgagagtcgttgccattgacggtggtgacgaaaagggtgactttgtcaagtccttgggtgctgaagcctacattgatttcctcaaggaaaagggcattgttgctgctgtcaagaaggccactgatggcggtccacacggtgctatcaatgtttccgtttccgaaaaagccattgaccaatctgtcgagtacgttagaccattgggtaaggttgttttggttggtttgccagctggctccaaggtcactgctggtgttttcgaagccgttgtcaagtccattgaaatcaagggttcttacgtcggtaacagaaaggatactgccgaagccgttgactttttctccagaggcttgatcaagtgtccaatcaagattgtgggcttgagtgaattgccacaggtcttcaagttgatggaagaaggtaagatcttgggtagatacgtcttggatacctccaaa

SEQ ID NO: 101 - DNA, 2115 bp, Candida viswanathii
atggctccatttttgcccgaccaggtcgactacaaacacgtcgacacccttatgttattatgtgacgggatcatccacgaaaccaccgtcgaccaaatcaaagacgttattgctcctgacttccctgctgacaagtacgaagagtacgtcaggacattcaccaaaccctccgaaaccccagggttcagggaaaccgtctacaacacagtcaacgcaaacaccacggacgcaatccaccagttcattatcttgaccaatgttttggcatccagggtcttggctccagctttgaccaactcgttgacgcctatcaaggacatgagcttggaagaccgtgaaaaattgttggcctcgtggcgcgactccccaatcgctgccaaaaggaagttgttcaggttggtttctacgcttaccttggtcacgttcacgagattggccaatgagttgcatttgaaagccattcattatccaggaagagaagaccgtgaaaaggcttatgaaacccaggagattgacccttttaagtaccagtttttggaaaaaccgaagttttacggcgctgagttgtacttgccagatattgatgtgatcattattggatctggtgccggtgctggtgttgtggcccacactttggccaacgatggcttcaagagtttggttttggaaaagggcaaatactttagcaactccgagttgaactttgatgacaaggacggcgttcaagaattataccaaagtggaggtactttgactacagtcaaccaacagttgtttgttcttgctggttccacttttggtggcggtaccactgtcaattggtcagcctgtcttaagacgccattcaaggtgcgtaaggaatggtatgatgagtttggtgttgactttgctgctgatgaagcatacgataaagcgcaggattatgtttggcagcaaatgggagcttctaccgaaggcatcacccactctttggctaacgagattattattgaaggtggtaagaaattaggttacaaggccaaggtattagaccaaaacagcggtggtcatcctcagcacagatgcggtttctgttatttgggctgtaagcacggtatcaagcagggttctgttaataactggtttagagacgcagctgcccacggttcccagttcatgcaacaggttagagttttgcaaatacttaacaagaaggggatcgcttacggtatcttgtgtgaggatgttgtaaccggcgccaagttcaccattactggccccaaaaagtttgttgttgctgccggtgctttgaacactccatctgtgttggtcaactccggcttcaagaacaagaacatcggtaagaacttaactttgcacccagtttctgtcgtgtttggtgattttggcaaagacgttcaagcagaccacttccacaactccatcatgactgccctttgttcagaagccgctgatttagacggcaagggccatggatgcagaattgaaaccatcttgaacgctccattcatccaggcttcattcttaccatggagaggtagtaacgaggctagacgagacttgttgcgttacaacaacatggtggcgatgttgctccttagtcgtgacaccaccagtggttccgtttctgctcatccaaccaaacctgaagctttggttgtcgagtacgacgtgaacaagtttgacagaaactcgatcttgcaggcattgttggtcactgctgacttgttgtatatccaaggtgccaagagaatccttagtccacaggcatgggtgccaatttttgaatccgacaagccaaaggataagagatcaatcaaggacgaggactatgtcgaatggagagccaaggttgccaagattcctttcgacacctacggctcaccttatggttcggcacatcaaatgtcttcttgccgtatgtcaggtaagggtcctaaatacggtgctgttgacaccgatggtagattgtttgaatgttcgaatgtttatgttgccgatgcaagtcttttgccaactgcaagcggtgccaaccctatggtcaccaccatgactcttgccagacatgttgcgttaggtttggcagactccttgaagaccaaagccaagttgtag

SEQ ID NO: 102 - DNA, 6120 bp, Candida viswanathii
atgtctactcatagacctttccaattgacccacggttccatcgaacacaccttgttggtgccaaacgagttgttcttcaactattcacagttaaaagacgaattcataaagaccttgcctgaaccaaccgaaggtttcgctggcgacgatgaaccttccagtcctgctgaattgtacggcaaattcctcggctacatcagtgacaacaccgttcaattcccccagatcttacaattgtccttgcaagacttccagcagcgattcttggacaaccacgacaacatccactcctttgccgtcagattattagaagatgaagcttatccaacaacaatcaccaaagtcaaggaaaatatcatcaagaactactacaaagccatcaagtccatcgacaaggtcgagtcaaacttgttgtaccactgcaaacatgacgccaagttggccgctatattcggtggtcaaggtaacaccgacgactactttgaagaattgcgtgaattgtacaccttataccagggcttgattgaggacctccttatctccattgccgacaagttggacgagttatacccttcttttgacaagatctacacccagggtttgaacatcttgggctggttgaagcacccagaaaccacccctgaccaagattacttgttgtccgtaccagtgagttgtcctgttatctgtatcatccaattgtgtcactacaccatcacctgcaaagttcttggtttgacccctggtgaatttagagactcgttgaagtggtccaccggtcactcccaaggtttggttactgctaccgctatttccagttccgactcctgggactccttcaaacaaaactccattgctgccgtctccttgatgcttttcattggtgccagatgtttgatggcttacccaagaactaccttgccaccaaccatgttgcaagactccttggaacacggtgaaggtagaccatctccaatgttgtcagttagagacttgaccatcacccaagttgagaagtttattgaacagaccaactctcacttgccaaaggaaaagcacattgccgtcagtttggtcaatggtgccagaaatttggttctttctggtcccccggagtccctttacggtttcaacttgaacttgagaaaccaaaaggctccaatgggattggaccaatcacgtgttccattcagtgaacgtaagttgaagtgttccaacagattcttgccaatttttgcaccattccactctcacttgttggctgatgccactgagtacattttggatgatgtcaaagaacaccgtttgtctttccagaaattgaagattgcagtctacgatacctacgacggctccaacttccaagagagcaaggaaccaattattgacagactcgtcaagttgatcaccgagttgccagttcactgggaaaccgccaccaaccacagggccacccacattttggatttcggcccaggtggtgtctccggtttgggtgttttgacccacagaaacaaggaaggtactggtgctagaataattgttgctggtgctcttgactccaacccaattgacgatgagtatggtttcaagcacgaaatcttccagacttctgccgacaagtccatcaagtgggctagcgattggttggaagaattcaaaccaactttggtcaagacttcccagggaaagatctacgtcaacaccaagttctcgcaattgttgggcagagctcccttgatggtcccaggtatgacaccaaccactgttaacccagacatcattgccgcctctttgaatgctggctatcacattgaattagccggtggtggttatttcgccggcaggatcatgaccaaagccattgaccaaattgttgccgacatcaagccaggttacggtttgggtatcaacttgatttacgtcaacccattcatgttgcaatggggtattccattgattaaggagttgagagaaaagggttatccaatccaatctttgaccattggtgctggtgttccatctttggaagttgccactgaatacattgaagagttgggtctcacgcacttgggcttgaaaccaggttcgattgacgccatcagccaagtcatcaccattgccaaggctcatccaaagttcccaattgtcttgcaatggactggtggtagaggtggtggccaccactcttttgaagatttccaccaaccaatcctccagatgtactccaagatcagaagatgcccaaacattgtcttggttgctggttccgggtttggttctgacgaagacacctacccatacttgactggttcttggtccaagagattcaactacccaccaatgccatacgatggtgtcttgtttggttccagagtcatgaccgccaaggaggcccacacttcgttggaagctaagaaattgattgcctcgtgcccaggtgtcccagatgagaagtgggagcaaacctacaagaagccaaccggtggtatcatcactgttagatctgaaatgggtgagccaatccacaagattgccaccagaggtgtcatgttctggaaggaattggacgacactatcttcaaccttccaaagccaaaagccttggaagccatcaagaagaagagagactacatcatcaagaagttgaacagcgacttccaaaagccatggtttggtaagaatgcttctggtgtttgtgacttgcaagaaatgacctacgaggaaatcgccaacagattggttgagttgatgtacgtcaagaagtctcaaagatggattgacgtttccttaagaaacttgtacggtgactttttgagaagagttgaagaaagattcacttctgctgccggcgtggtttccttgttgcaaaacttcatccagttgaacgacccagaaacattcagtgccgagttcttcaacaagttcccacaagccaaggaacaattgatttccgaagaagacgctgaccactttttgttgttggctgccagaccagggcaaaagccggttccattcgtgccagtcttggacgaaagatttgaattcttcttcaagaaagattctctttggcaatctgaagacttggaaagtgttgtcgacgaagacgttcaaagaacttgtatcttgcacggtccagttgcctcccaattcaccaagaaggttgatgaaccaattggcgaaatcttggactctatccacgagggccatattgccaagttgatcaaggatgaatacgctggtgatgcatccaagatcccagttgttgagtacttcggtggtttcaagaccgacaaggttaatgctaacaatgttcaagtcaatgctaccagaaaggaaaccgtctacgaaattggttccaagttgccagccaggcaagactggttggacttgttggccggtactgaattgaactggttgcacgctttcatctccaccaacagaattgtccaaggctccaagcacgtcgccaacccattgcacgacattttggctcccgttgccagatccagtgtttccattgacaaggctaccaagaaattgactgcttatgaaaaggtcaagggtgagttggttccagttgttgaaattgaattggtcaagccaaacaccattcaattgtctttgattgaacacagaactgctgatggcaaaccagttgctttgccattcttgtacaagtacgacccaactgatgggtttgcaccagtcttggagatcatggaaaacagaaacgacagaatcaaggaattctactggaagttgtggttcggtgcttccgtcccttacgacaatgacatcgatgtcgaagagcaaatcttgggtgacgaaatcaccatttcttctcaagacattggtgaattcacacacgctattggtaacaagtgtgaagcctttgtcaacagaccaggtaaggtcactttggctccaatggatttcgccattgttgttggttggaaagctatcatcaagtccatcttcccaaagaccgttgacggtgacttgttgaagttggtccacttgtccaacggttacaagatgatccctggtgcagctccattgcaaaagggcgatgttgtttccactagatctgacatcaaggctgttttgaaccaaccaagtggtaagttggttgaagttgttggtaccatcttccgtgaaggcaagccagttatggaagtcacttcacaattcttgtaccgtggtgaatacgacgactactgcaacaccttccaaaaggtcactgaaactccagttcaagtctcattcaagtctcctaaggatttggctgttttgagatccaaggaatggttccatttggaaaaggatgtcgagtttgatgctttgactttcagatgtgaatccacttacaagttcaagtctgccaacgtctactcgtccatcagaacgaccggtcaagttttcttggagttgtccaccaaagaagttatccaagttggttctgttgactatgaagctggtacctcttatggtaacccagtcactgactacttgaacagaaacggtaagaccattgaagaggctgttacttttgagaatgccatccccttgtcgtctggtgaagagttgaccaccaaggctccgggtaccaacgagccatatgctattgtttctggtgactacaacccaatccacgtttccagagtcttttctgcttacgccaagttgccaggtactatcacccacggtatgtactcttctgccgccatcagagccttggttgaagagtgggctgccaacaacgttgccccaagagtcagagccttcaagtgtgaatttgttggtatggttttgccaaacgacactttgcaaaccactatggaacacgttggtatgatcaatggccgtaagatcatcaaggtcaagactgtcaatgccgagaccgagactccagtcttgcttgctgaagccgaaattgaacaaccaaccaccacctatgttttcactggtcaaggttcccaagaacaaggcatgggtatggatttgtacaactcttctgaagttgcccgtaacgtttgggataccgccgacaagcatttcatcaaccactatggcttctccatcttggacattgtgcaaaacaaccctaaggaattgactatccactttggaggtgctaaaggtagagctatcagagacaactacattggtatgatgtttgaaacaattggtgaagacggttctttgaagtccgaaaagatcttcaaggacattgacgaaaacaccacttcctacacctttgtttctgacactgggttgttgtctgctactcaattcacccaacccgctttgactttgatggagaaggctgcctacgacgatatcaagtctaaaggattgattccaagtgacatcatgtttgctggtcactctcttggtgaatactctgctttgacttccttggccaacgttatgcctattgaatccttggttgatgttgtcttctacagaggtatgaccatgcaagttgctgttccaagagacgagtttggtagatccaactacggtatggttgctgtcaacccaaccagagtcagcccaacatttgacgatgccgccatgagatttgttgttgacgagactgccaagagaaccacctggttgttggaaattgtcaactacaatgttgaaaaccaacagtacgttgctgctggtgacttgagagccttggataccttgaccaacgtgttgaatgttttgaagatcaacaagattgatattgtcagattgcaagaacaattatccctcgacaaggtcaaggagcacttgtacgagattgttgatgaagttgctgccaagtccattgctaagccacaaccaattgaattagaaagaggttttgctgttatcccattgaagggtatttctgtcccattccactcttcctacttgatgtctggtgtcaagccattccagagattcttgtgcaagaagattccaaaggcttccatcaaaccacaagatttgattggcaagtacattcctaacttgactgctaagccatttgaacttactaaggaatacttccaggatgtctacgacttgactaaatctgaaaagatcaaggctatcttggacaactgggaaaaatacgaatag

SEQ ID NO: 103 - DNA, 5661 bp, Candida viswanathii
atgaagccagagattgaacaagaattatcccacaccttgttaacagaattgttagcttatcagttcgcttctccagtcagatggatcgaaacccaagatgtcttcttgaagcaacacaacaccgaaagaatcatcgaaatcggcccttccccaaccttggccggtatggccaacagaaccatcaaggccaaataccaatcctacgacgccgcgttgtccttgcaaagagaagtcttatgctactctaaggacgccaaggagatctactacaagccagatccagcagatcttgctccaaaggaagaaccaaagaaggaagaagctgccgccgctccagccgctacaccagctgctgctgctgctgctgctactcctgctgctgccccagtcgccgctgctccagccccatctgctggccctgctgaatccatcccagatgaaccagtcaaggcttccttgttgatccacgtcttggttgctcagaaattaaagaaaccattggatgctgttccaatgtccaaggctatcaaagatttagttaacggtaagtccactgtccagaacgaaattcttggtgacttgggtaaagaattcggttccactcctgaaaaaccagaagataccccattggaagaattggccgaacagttccaagactccttcagtggtcaattgggtaagacttctacttcattgattggtagattgatgtcttctaagatgcctggtggtttctcaatcaccgctgccagaaaatacttggaatccagattcggtttgggtgccggtagacaagactctgtcttgttggttgctttgaccaacgaacctgcaagcagattgggttctgaggccgaagctaagaccttcttggacaccatggctcagaaatatgcctcatctgctggtatttccttgtcgtcagcttctgccggtgccggtgctggaggtgccgccggtggcgccgttgttgacagtgctgctttggacgccttgactgctgaaaacaagaaattggctagacaacaattagaggtcttggctagatacttgcaagtcgacttgaactcaggagctaagtcttttatcaaagaaaaagaagcttccgctgttttgcagaaagaattggacttgtgggaagccgaacatggtgaattctacgccagaggtatcaaaccaactttctcagctttgaaagcaagaacctatgattcctactggaactgggccagacaagatgttttgtccatgtactttgatattttgtttggtaagttgacctccgttgacagagaaaccatcgaccaatgtatccaaattatgaacagatccaacccaactttgatcaagttcatgcaataccacattgaccactgcccagaatacaagggtgagacttacaagttggccaagagattgggtcaacagttgattgacaactgtaagcaaaccttgaatgaagacccagtgtacaaggacgtttctagaatcactggtccaaagaccaccgtctgcgccaagggtaacattgaatacgaagaagccgaaaaggattctgttagaaagtttgaacagtacgtctacgaaatggcccaaggtggtgaaatgaccaagattgcccaaccaactattcaagaagacttggccagagtttacaaagccatctccaagcaagcttccagagacagcaagttggaattgcagaaagtctacgagcaattgttgaaggttgttgctggttcagacgaaattgaaactcagcaattaaccaaggacatcttgcaagctccaactggctccaacaccccaactgatgaagatgaaatttccaccgccgactctgacgatgaaattgcttcattgccagacaagacttcaattgcccaaccagtttcttcaactgttccaccccagaccatcccattcttgcacattcaaaagaagaccaacgaaggctgggaatacgaccgcaagttgtctgccctttacttggacggtttggaatccgctgctgtcaacggtctcaccttcaaggacaagtacgttttggttaccggtgctggtgctggatccattggtgccgaaatcttgcaaggtttgatcagtggtggtgccaaggttgttgttaccacctctagattctccaagaaggttactgagtactaccaaaacatgtacgccagatacggtgctgccggttctactttgattgttgttccattcaaccaaggttctaaacaagatgttgacgctttggttcaatacatctacgacgatccaaagaagggtggtttaggctgggacttggatgccattatcccattcgctgctatcccagaaaatggtaacggtatcgacaacattgattctaaatccgaatttgcccacagaattatgttgaccaaccttttgagattgttgggtgctgtcaaatccaagaagactaccgacaccagaccagctcaatgtatcttgccaatgtctcctaaccacggtactttcggtttcgatgggttgtactctgaatccaagatttccttggaaaccttgttcaacagatggtactccgaagattggggctccaagttgaccgtctgtggtgccgttattggttggaccagaggtactggtttgatgagcgccaacaacatcattgccgaaggtatcgaaaagattggtgtcagaaccttctcccaaaaggaaatggctttcaacatcttgggtttgttgactccagagattgtcaagttgtgccaagaagaaccagttatggccgacttgaacggtggtttgcaattcattgaaaacttgaaggatttcacttccaagttgagatctgacttgatggaatccgctgaagttagaagagctgtctccattgaatccgccatcgaacaaaaggttgtcaatggtgacaatgttgatgccaactacaccaaggttaccgttcaaccaagagccaacatgaaattcgacttcccaaccttgaaatcgtacgatgagatcaagaaggttgctccagaattggaaggcatgttggacttggaatccgtcgttgttgtcaccggttttgccgaagttggtccatggggtaacgccagaaccagatgggaaatggaatccaagggtgaattctccttggaaggtgccattgaaatggcctggatcatgggtttcatcaagtaccacaacggtaacttgaagggtaagccttactctggttgggttgatgccaagacccaaactccaatcgatgacaaggacatcaaggccaagtacgaagaagagatcttggaccactctggtattagattgattgagccagaattgttcaatggctacgatccaaagaagaagcagatgatccaagaagttgtcatccaacatgacttggaaccatttgaagcctccaaggaaactgctgaacaatacaaacacgaacacggtgacaagtgtgagatctttgaaattgaagaatccggtgaatacactgttagaatcttgaaaggtgctaccttgtttgttccaaaggctttgagatttgacagattggttgctggtcaaattccaactggttgggatgctcgtacctacggtattccagaagataccattaaccaagttgatcctatcactttgtacgtcttggttgctaccgttgaagctttgttgtctgctggtatcaccgacccatatgaattctacaagtacgtccacgtttccgaagttggtaactgttctggttccggtatgggtggtgtctctgccttgagaggaatgttcaaggacagatacgccgacagaccagtgcaaaacgatatcttgcaagaatctttcatcaacaccatgtccgcctgggttaacatgttgttgttgtcttcttcgggtccaatcaagaccccagttggtgcctgtgctaccgctgttgaatccgttgacattggtattgaaactattttgtctggtaaggctaaggttgttatggttggtggttacgatgacttccaggaagaaggttcttatgaattcgccaacatgaatgccacttccaactcccttgacgagtttgctcacggcagaactccaaaggagatgtccagaccaactaccaccaccagacacggtttcatggaggcccaaggttctggtatccaagttattatgactgctgacttggccatcaagatgggtgttccaattcacgctgtgttggccatgtctgctactgctaccgacaagattggtagatctgttccagctccaggtaagggtattttgaccactgccagggaacaccacggtaacttgaagtacccatctccagctttgaacatcaagtacagaaagagacaattgaaggctagattagaccaaatcaaggcttgggaagaagctgaaattgcttacttgcaagacgaagctgagttggccaaggaagaaatgggcgatgagttctccatgcacgaattcttgaaggaaagaactgaagaagtgtaccgtgaatccaagagacaagtttctgacgctaagaagcaatggggtaaccaattctacaagtctgacccaagaattgctccattgagaggtgccttggctgctttcaacttgaccattgacgatcttggtgttgcttccttccacggtacttctaccgtcgccaacgataagaacgaatccgccactattaacagcatgatgcaacacttgggcagatctgaaggtaacccagtgtttggtgttttccagaagtacttgactggtcatccaaagggtgctgctggtgcttggatgttgaacggtgccatccagatcttggagtctggtattgttccaggtaacagaaatgccgataacgttgacaaggtcttggaagaatacgagtacgtcttgtacccatccagatccatccaaactgacggtatcaaggccgtttccgtgacctctttcggtttcggtcaaaaaggtgctcaagctgttgtcgtccacccagactacttgtttgctgttttggatagatctacttatgaggactacgccaccagagtttctgccagaaacaagaagacttaccgttacatgcacaatgctattactagaaacactatgtttgttgctaaggataaggctccatatgccgatgaattggaacaaccagtttacttggacccattagcccgtgttgaaaacgctaaggaaaagcttgccttcagcaacaagagtatccaatccaaccaagcttatgctggtgaaaatgccagaaccactgccaaggctttggctgccttgaacaagtcatccaagggtgttggtgtcgacgttgaattattgtctgagctcaacttggagaatgaaacttttgttgcaagaaacttcactcctggtgaaatccaatactgctccaagagtgccaacccacaagcttcatacaccggcacttggtctgctaaagaagctgtcttcaaggcattaggtgttgaatctaaaggtgctggtgccagcttggttgacattgagatcactcgtgacgtcaacggcgctccacaagttgtcttgcacggtgatgcggcaaaatcagccgccaaagctggtgtcaagaacgtcaagatttccatctcccatgacgacttccaagccactgctgttgccttgagtgaattctag

SEQ ID NO: 104 - DNA, 1029 bp, Candida viswanathii
atgttgagatcttcagtccgtactttctccacccagtccagagtattagccaactacggtttcgtaggcttgggtctcatgggccagcacatggccagacacgtctacaaccagttgcagccagcagacaagttgtatgtccacgacgtcaacccccagcacaccacccagttcgtcaccgacgtgaccacccagaagccacagaacgccacacaattgacgcccttgtcctccttgaaagagttcaccaccgagccagagtcccagttggacttcatcgtcaccatggtccccgagggcaagcacgtcaaggccgttgtctccgagctagtcgaccactacaatgcgtcgggaaaatacgacccatccaagaagttgacctttgtggactcctccaccatcgacatccccacctccagggaggtccaccagctcgttgccgacaagttacaaggcgccacgttcatcgacgccccggtttcgggtggtgtcgctggtgccaggaacggaaccttgtcgttcatggtgtcgcgggacaccaaggaagacgtcgaccctaacctcgtcacgcttttgaactacatgggcagcaacatcttcccatgtggtggaacccacgggaccggcttggctgccaagttggcaaacaactacttgttggcgatcacgaacatcgccgtcgcagatagcttccagttggcaaactcgttcgggttgaacttgcagaactacgccaagttggtgtcgacctccacaggtaagtcctgggctagtgtcgataactgcccaatccccggtgtctaccctgaaaagaacttgacttgtgataacggatacaagggtgggtttgtcacgaagttgacgagaaaggatgtcgtcttggctacggagtctgctaaggctaacaaccagttccttatgcttggcgaagtcggtagatactggtacgacaaggcttgtgaagatgaaaagtacgccaacagagacttgtctgttcttttcgaattcttgggtgatcttaaaaaataa

SEQ ID NO: 105 - DNA, 1650 bp, Candida viswanathii
atgttatccagagttcttttcaagactaaaccaagagttcctactaaatcaatcaccgccatggccatcagaaacaaatccatcgtgactttatcctccaccacctccacatacccaaccgaccacacgaccccgtccacggagccatacatcacgccatccttcgtgaacaacgagttcatcaagtcggactccaacacctggttcgacgtgcacgacccggccacgaactacgtcgtgtccaaggtgccacagtcgacgccggaggagttggaagaggcgatcgcgtcggcccatgccgcgttccccaagtggcgcgacaccagcatcatcaagcgtcaggggatcgcgttcaagtttgtgcagttgttgcgcgagaacatggacagaatcgcaagcgtcattgtcttggaacagggtaagacgtttgtcgatgcccagggtgacgtgactagaggattgcaggttgctgaggctgcgtgcaacatcactaatgacttgaagggtgagtcgttggaagtgtctactgatatggagaccaagatgattagagaacctttgggtgttgtgggatccatctgtccttttaacttcccagctatggtcccattgtggtctttgcctttggttttggtcacgggtaacactgctgtgattaagccttccgagagagtcccgggcgcaagtatgattatttgtgaattggccgccaaggctggtgttccacctggtgtgttgaacattgtccacggtaagcacgacaccgtcaacaagttgattgaggacccaagaatcaaggcattgacttttgttggtggtgacaaggccggtaagtacatttacgaaaagggttccagtttgggcaagagagtgcaggccaacttgggtgctaagaaccacttggttgtgttgccagacgcacacaagcagagttttgtcaatgccgtcaacggtgccgctttcggtgctgctggacagagatgtatggctatttctgtcttggtcaccgtgggtaagaccaaggaatgggtgcaggatgtcatcaaggacgccaagttgttgaacaccggaagtggatttgacccaaagagtgacttgggtccagtcatcaacccagagtccttgactcgtgctgaagaaatcattgctgattccgtggccaacggtgccgtgttggaattggacggaagaggatacagaccagaagacgctagattcgccaagggtaacttcttgggtccaaccatcttgaccaacgtcaagccaggcttgagagcatacgacgaagagattttcgctcctgttttgtctgtggttaacgtcgacaccattgacgaagccattgagttgatcaacaacaacaagtacggtaacggtgtttcattatttacttcctccggtggctcagcccagtatttcaccaagagaatcgacgtcggtcaagtcggtatcaatgtcccaatccctgttccattgcctatgttctccttcactggttccagaggctccttcttgggtgacttgaacttctacggtaaggccggtatcaccttcttgaccaagccaaagaccatcactagtgcctggaagaccaacttgattgatgacgagatcttgaaaccatctacctcgatgcctgtccaacagtaa

SEQ ID NO: 106 - DNA, 726 bp, Candida viswanathii
atgtccgacgaggaatcagatatcttatacgaggtcagagacagaaccgccatcatcaccttgaacatccccaagagattgaacgcattgaacggtgctcaatacttgaagttgggtaagttcttggagagagccaacaacgaagaggacaccgtcttgacattgatccaggccctgggcagattcttctccgccggtgccaatttcgccgacaacgatatggccaaggtcgaaatgtccaagttgttcagtcacgagtactggttggaaagattcgtcgccagaaacatctggttgaccaacttgttcaacgaccacaagaagatcttggctgctgctgtcaatggtccagttatcggtttgagcactggtttgttgttgttggtcgatttggtctacgtccacgacttgaacaagttctacctcttggccccatttgccaacttgggtttggttgccgaaggtgcttcctctgccactttgttcaacagattgggctggtcaaaggcttctgaggccttgttgttggccaagccaatcggcggccaagactgttacaacgccggtttcatcaacaagcactacgacggtaagttttcctccactgaagagttcaacgaacacgtctacaaggagttgacggaagcttttgaaaacttgcacgatgactccattttgcagaacaagcaattgttgaagttgtccagagaccaggccatcaactag

SEQ ID NO: 107 - DNA, 807 bp, Candida viswanathii
atgtccgacgaccttatcacctacgaagtcaaagaccgagctgccgtgatcaccttgaacaaccccaagaagctcaacgccttatcgatcccgcagtacgacaccatctgcaagctcttagaacgagccaacgccgaagaagacaccgtcatcaccttgctccagtccacgggccgggtgttctctgccggggccaacgccgactccatcgtggggcaggatgccgagctcgagacctggttgaacatgtcggtggccaagcagacgttcttggtgcagacgttcctcgcacacaagaagatccttgccgtcgccttgaacggccccgtgattggcttatcggcggcgttcgtggcgctctgcgacttggtctacgtgcacaacgccgcaaagacgttcttcttgaccccgttcgccaacatcgggatccttgccgagggcggcacctcagccacgttgcccatgcgcgtggggtggtccagggccgcggaagcgttgttgttgtcaaagaggatttcgggagatgacttgcagagagcggggttcttcaataaggactacaaggggcagttcaagtccgcggaggagtttaacgaggtcgtcttgaaggagttgcttgacgccacggaaaacttgcatgaggactcgatcatccagaacaaggagttgttgaaggctattttcaagccaaagatcagtgaggtcaactcgcaggaggtgtcaagaggtgtgtacaagtggacctctggggtgccaatggatagatttaaaaaattgcttaatggtgagttgaaacataaattatag

SEQ ID NO: 108 - DNA, 876 bp, Candida viswanathii
atgccaaacactttagatcacaactaccttaagaaaagcgtctggaagtcagatatctttgccggcaaagtcatcttcatcactggtggtgccggtaccatctgtcgtgtgcaagccgaagccatggtcttgttgggtgctaatgctgccatcattggtagaaacgtcgaaaagactgaagaagccgctaaggagattgcttccttgagaccaggagccaaggtcattggtattggtgccgttgacgtgcgtaagatccaaactatcaaggatgccgttgacagaactgttgccgagttgggcagaatcgactatgtcattgctggtgccgccggtaacttcctttgtgacttcaaccacttgtctgccaacgccttcaagtccgtgattgacattgatttgttgggttctttcaacaccgtcaaggttacctttgaccagttgagaaagaacaaaggtgccgtgttgtttgtcagtgccactttgcactacaccggtgttcctatgcaatcgcacgttggtgctgccaagtctggtgttgatgccttgagcaacgcccttgctgttgaattgggtccattgggtatcagattcaactgtattgccccaggtgccattgctggtactgaaggtatgctgagattggccccacctaccgacacgccattggagacgaagattccattgcagagacaaggtactactgaggacattgctgatgccactgtgtttttgttctcgccagcttcctcctacattactggtgatgttttggttgttgatggtgctatgtggcaaactggcggaggtattcttaacgacttctacccagacatcattattcaccagaacgccgacccagaaggtaagttgtaa

SEQ ID NO: 109 - DNA, 879 bp, Candida viswanathii
atgccaaacactttaactgaagcatacaaacaagaaagttcttggaagccagatttgttcaagggcaaagtcgtcttcatcaccggtggtgcaggttcgatctgccgtgtccaggccgaagccatggtcttgttgggtgccaacgctgccatcattggtagaaacgtcgaaaagaccgaatccgccgccaaagaaatcgccagcttgagatcaggagccaaggttcttggtattggtggcattgatgtgcgtaaagttgacagcttgaagagcgccgtcgataagaccgttgccgaattgggcagaatcgactttgtcattgctggtgccgccggtaacttcctttgtgacttcaaccacttgtcttccaacgccttcaaatccatcattgacattgacttgttgggttctttcaacaccgtcaaggtcacttttgaccaattgagaaagaacaagggtgccatcttgtttgtcagtgccaccttgcactactacggtgttcctttccaaattggtgttggtgctgccaaggctggtgtcgacgccttgagcaatgcccttgccgttgagttgggtccattgggcatcagatccaactgtattgccccaggtccaatcgacggtaccgaaggtgttgaaagattggtcagagcttccaaggccgaagccgccaagaaggttccattgcaaagattgggtactacacaagacattgctgacggtaccgtctacttgttctccccagccgcctcctttgtcactggtgacgttttggttgttgatggtgctagctggcagatctcctctggtgttggtgccaccaactacccagtctccatcctcaatgcgatcgacgcaccgaagggtggtaagttgtaa

SEQ ID NO: 110 - DNA, 4262 bp, Artificial Sequence
  Description of Artificial Sequence: Synthetic polynucleotide
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcgagttcggcatggcagatcatcatgcctgcaggagctccaattgtaatatttcgggagaaatatcgttggggtaaaacaacagagagagagagggagagatggttctggtagaattataatctggttgttgcaaatgctactgatcgactctggcaatgtctgtagctcgctagttgtatgcaacttaggtgttatgcatacacacggttattcggttgaattgtggagtaaaaattgtctgagttgtgtcttagctactggctggccccccgcgaaagataatcaaaattacacttgtgaatttttgcacacacaccgattaacatttcccttttttgtccaccgatacacgcttgcctcttcttttttttctctgtgcttccccctcctgtgactttttccaccattgatataaaatcaactccatttccctaaaatctccccagattctaaaaacaacttcttctcttctgcttttcctttttttttgttatatttatttaccatcccttttttttgaatagttattccccactaacattgttcaaatcttcacgacataagaagagcccgggtctagatgtgtgctcttccgagtgactcttttgataagagtcgcaaatttgatttcataagtatatattcattatgtaaagtagtaaatggaaaattcattaaaaaaaaagcaaatttccgttgtatgcatactccgaacacaaaactagccccggaaaaacccttagttgatagttgcgaatttaggtcgaccatatgcgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccaaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 111 - DNA, 7638 bp, Artificial Sequence
  Description of Artificial Sequence: Synthetic polynucleotide
cccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttccgttaaacaaaaatcagtctgtaaaaaaggttctaaataaatattctgtctagtgtacacattctcccaaaatagtgaaatccagctctacaatttggctttaccggtacaaatcaaagaccaatcgtcttcagtcaactcctggtacttgtcgccattcaaccagtagatcaaatccttgccgtcttcaccctttggcaacttttggttcttgaattggttcttaggaaccttgtggttgtgcgaagcctcaatggtgccaatcttgatgaacgcaggttgagcatacacaggcaaagacttggtcacgtgagagtgaatcaatttcaagatttcttcatggctcaactcgtccttggcttcacagacggcaaaacaggctctaccttcgtggtttggcaccttgacaccgacaacgacggactgcttcaaggccttggagcccatcaattcgttctcgacctcggtggcggagacgttttcggacttccaacggaaagtgtcacctaatctgtcgacaaagtacaacaatttgtcctcgtccatcttcaacaagtcaccggatctgtaccacgcgtcaccttttttgaaaacattggtgaggattttgctgttggtggcggacttgttaccataataaccctggaaggatttctgcacgtcgttagggttcaagattctcatcaacaactcacctggctcgttgtaagcggcctcggtacagaacccggtcttggggtccttgtagatttcactctcgtcttctgggtccatcttggccaatttctgctgggtagacaataacaagctgatgagggacccgtacttacgacaggcgccgacaccgtactcaccgtactgcaagttggtggtggcgataggggactcggtggcggcgtagaactcaccgataccttcaatgtggaatctgcgcttgaactcagaccatatatctggacgcaacccgttaccgtaggcaattctgacattgtgtctgtcttggtctggatgaggcttggagttcaacaagtaacgacagacctcaccgacgtattgcacgtgggtggcaccacataatctggcctgggtccagaacgaagtagcggagaatttctgggacacggagacacagccaccgacaatcaaagtaggacacaaccccaacatggccgcggtggagtggtacaagggcatggcggtcaagacgttcgatttcgagtcaatcttcatgatgtggccaaagaaaaccgaggccatgaaggcttttctccaggacatgataccggcttttggcaaaccggtggtacccgaggtgtaaatcaatgcacaagcggaggagtcagtatcggttggtcttctggtcttgtcctcggctctgtgttttggagtcgacttgagtctcaatctgtcaaacaaggcaaactcgtcaatgtagtttatttgcacatgtggcaattcctctctgatctgagcctcggtatctctgattggggaatcacagtccgggtcaacgaaaacttgcgaagcgttgacaatcttaagacagtggatcaatggcttgtccttggtgttgaagttcaagaacgcaggcaaggcaccaatgttccacaatgccaaccacaagacaatgaaaagcggcttgttcatacaagaaacaccgatggtgtcgttggcagtgacgccgtactcgttcttcaagatgtatgagtacttcaaaaccatgtcgtacaattccttgtaggtgtattcttctaggtcaaactgatcgtcgtagatccactagtaacggccgccagtgtgctggaattcgcccttgggctaacgaaaaggaaaccgctgacgttaaaggtatctacggttgtttcggtatgacccccggggatctgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccaaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctacggtcgacgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcagagctcggtacccggggatctggaatccctcggcgtcggtcttgggggtgggggcattctttcttggtcttgggaacgccaacgctttgttgtttgggttcttgaacacggactgctcgaaaaagtaccagtatgatgccttacctctgctggctttccacaagtatgggagggcattgacagcgactgtcttggctaacagcacgtcgtcggcaattaaatatttggcttccaataactgactaccaaggatggcagcagcggctatttctaatcctgacatgtttctcgtacgtagtagtgaatgaagggaaggtggaataatatcaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagac

SEQ ID NO: 112 - DNA, 7963 bp, Artificial Sequence
  Description of Artificial Sequence: Synthetic polynucleotide
cccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgccctttaaacgttgggcaaccttggaggggtgtgctgatgccctttctgtgtatgtttttgtgctaaccattgcgaattgagctgggggtttgatgacgatgatgatggggaggttgatctttgggtttgattttttttttcactttttttttttcttgggagttggggaatggatgagatatctcacgtgactagtatggcaatttattgtataaatctgtattccttactttgtttgttatataatacaaaatacttatttaccttcttcttcttgtttcacctcttcgtttgcttcttcctgtttagcttctggttgaccactttccataaactctttcttcaattgtggataaatctcatccattttatcacatgacgccttgtatatctgtgcattctcagtctggtccaagaacttgatgttctgtaacaccaagatcatgttcttgatcaattcaatacaattctcgttgtacccgtcgcatatggtcgacctaaattcgcaactatcaactaagggtttttccggggctagttttgtgttcggagtatgcatacaacggaaatttgctttttttttaatgaattttccatttactactttacataatgaatatatacttatgaaatcaaatttgcgactcttatcaaaagagtcactctcttctattcttaactggacaagatttcagcagcttcttcggacttttcacctctttctctgacttcaaggtctggacggttcaacatgtcttccaaagccttggagtatggagccttggtgttttctggtgggttcaaagccttgacagtttcgaagtagtgttcgtagacgttaccatcatatctaccaatagcagcattggtcatcatgtcagtcaagttgaaaccatcagtcaaaccaacaacgtttggtctaaccttggcacacaaggctgggaagtgctcggaggaaatctttctgctgacatctggggtaatgataccgtactgcaagaaggtggcaccaaagttggtcaagatccagtcggcatacaagaaacccaaaggtctcaagacttcagaccattctggggtgatacgcttgaagaaaccgtcaatcaagaatctgtgagcgttcaacttggaaaccaaaaccaaacttggaccggtaatgtcgaaacccttgtcttcagcaacagcaccaatgtctctggccaagccggaaagggcgtggtcgaaagccttaaccaacttggctgggtcgtccaagtcggcaacgctggagagaaccaatcccttttgttctggctccttcaacaagtctctaaccattggcttggcaacgttcatggccaagatgttgttgtcaccttcccaggtacattggacaacccagtcggagtaggctttaccgaaaccgttgtaagacgagtaaccgtgaccaccacaagcttgacgagcttcgtcaatggcttcagcagtcaaccaggtacaggtggacttcaaacaaccggaagcgacgaacaatttcttggattcgacaatggcagcgtcaatggcttccttttcaccagcactgacagcttcgtccaacttgtcgttggttgcgttcatggtttgttctaagtacaaggcaccttgggagaacaagtaagcggcagccaagaatgggaacaatctcttttgatgcaatgggtagtcaatcaacttggtttcaatggtatcggtgtccttcttcttgaattgtcttctgtggatggcgtatctcaaggcaatggtgatgaatctactggtcattctgtaggagtccatcatcatggtgactctaccaccaatcaaagccgagtaagacaattgttcagatggtggcatggtgacttcacccagacgggaaaccttacagtacttttgcaacataaagaatcttgggattctgacgttggagaactggatccaaccgttatcgataccgtctctacccatcttggcaccaatgtcaccaacagtcacacctggctcgaggtcgtggttggagtctctcaatgggacaacaaaggtcttgacaccgtagtcctttcctttgaccttcaatctggcgtagacggagcagtgggtggcggagtgcgcagcaccaccgatccaccacttggtggcaccaatgtgtggggtgttgatgacaaactcgtcagtgtcttcgtcaaaagtggcggtggtttcaataccttggacgttggaaccgtgggccaactcagtcataccaaaacaaccatagatacctctcaacttgtcgatacccttatttatggtccagtagaagaactgggagttggtaccgttaccacggacacaggaaacaaacaaacccaagttgacaccgattctggttccgacttgtgggtcaaagacaccgaggatcgacaatctctgggcctgttggtctgggtactcgtgctcaaagtatctggagagtctggcaatcttcttggcggtgacttctctttgttggtctttggtcaagttgtagtatgaagcgtcgaccttcaagatagggtctttttgcatttgttcgaccatgttgctgatgatctcggatctttcttgggaaccttccaagaagtagttcaactcctttgggttgaacttggtgagttctctttctttttgaagttcggtaggcatgattgattgttatagtttctttctttcttttgaggatgaccagatgtttgataataatcagataggtaggaaaagaataaaaaaaaactaatatggtaggaaagaagaaaaaaaatggtggatgtgaagaattgtgaaaaggggggccaatgcctgaagtttatataaagattcaggctccagagtttgccctgttgattctgcggggggccacacacaagcacactgcagacaggaatagtgggggtagtgtgcatgtggataaaaatgcctgtgttttttttttctgtttcttctgatgccattgtcgcacgggcacaactttggctgtctgcccccccaggcgtaataaccgaggattatctcacaactacagttgtcacttttgccagcaaaataggaatcaacaagcaatgggttatataacactgcttatacagactactaccaatcccaatacacaccactgagcctactactcacagaaattgagcgaccaccacccaattgatcgggaatatgtctccctgattatttttccacactttaattaccccataaaacggttacatcaaggataatgaagtgggatatgcaaagtttcaattttttcctctccgctctaaccaagggattctccatctctatccgtggtccaaacagggccaaacaccacccaagctctactctagaaccttctggtatctacgtgccagcttaattacatcaactcaacgactcttcttcccttctgcaggcatgatgatctgccatgccgaactagacgaagccgttcttcaaggtgtattacaactcgtacgtggataccttcaagcaagtgatgcggatgaagcaaagggcgaatgtgacgtggtttgaggcggcgtactctgggtttgtcaggaacgcactaaccaccatccctgctacatccattgcgttattggttttcgaaatcatgagaactaaactagcagacaacttcgaagactacaatgacgtcctagaagcttagtgtatgtatatagacctatttattacaatatttattctaactgaccagttctcttcaagtatgccttccatccagcatccctgtatctctttccctccacctcagggtctcttccttttccaaacaaccctctcccgacaataatcacatcggtaccagtcagaaccacctcatcaacagtcctatactgctggcccaacgcatcgcctttatcatccaaccccacaccaggcgtcatgatgatccaatcaaacccttcttctctaccccccatgtcccgctgcgcgatgaacccaatcacgaactcccgatcactcttcgcaatctcgatcgtctcacgggtatattcaccatgcgccaacgagcctttactcgacaactccgccaacatcaacacgcccctttccttttctaccccctccgcaccgcgtttcaacccttcaacgacgcccttcccagtcactccgtgcgcgttcgtgatgtcactccacgccgcgatccggtatacccccgaggtgtactgcaacatcacggtgtttccgatatcagcaaacttcctgtcctcgaatatcaagaacccgtggcgctctgcaagcacaagcaacggctcaatcgtgccctcgtagctgaagtctgagatgatatcgatgtgcgtcttcacgagacagatgtggggaccgagcttgtcgatgagcgaaaggaactcggcggttgtggtcacgtcgatcgaggcgcagaggttggtctttttggactccattaagcggaaaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagac

SEQ ID NO: 113 - DNA, 751 bp, Candida viswanathii
aagggaagaagagtcgttgagttgatgtaattaagctggcacgtagataccagaaggttctagagtagagcttgggtggtgtttggccctgtttggaccacggatagagatggagaatcccttggttagagcggagaggaaaaaattgaaactttgcatatcccacttcattatccttgatgtaaccgttttatggggtaattaaagtgtggaaaaataatcagggagacatattcccgatcaattgggtggtggtcgctcaatttctgtgagtagtaggctcagtggtgtgtattgggattggtagtagtctgtataagcagtgttatataacccattgcttgttgattcctattttgctggcaaaagtgacaactgtagttgtgagataatcctcggttattacgcctgggggggcagacagccaaagttgtgcccgtgcgacaatggcatcagaagaaacagaaaaaaaaaacacaggcatttttatccacatgcacactacccccactattcctgtctgcagtgtgcttgtgtgtggccccccgcagaatcaacagggcaaactctggagcctgaatctttatataaacttcaggcattggccccccttttcacaattcttcacatccaccattttttttcttctttcctaccatattagtttttttttattcttttcctacctatctgattattatcaaacatctggtcatcctcaaaagaaagaaagaaactataacaatcaatc

SEQ ID NO: 114 - DNA, 991 bp, Artificial Sequence
  Description of Artificial Sequence: Synthetic polynucleotide
ttgtccaatgtaataatttttccatgactaaaaagtgtgtgttggtgtaaagaagaaagtggaagggacgttggtgatggtgagttcgtctatcccttttttatagttgcttgtatagtaggctactcttctagggactcgatgggggaaggttcttgatatttgcttagttcgagaaggttccagatgagcgagacatttttggtacgacattgggtggatgatctgcacgacattttgtgattcttgcgacacgctgcactaccaagtgtagtctggctgaacggatcacaagataaacctctgaaaaattatctcagggcatgcaacaacaattatacatagaagagggagtcacgatatacacctgtgaaggaatcatgtggtcggctctccttgaactttgaattcatgcaattattaagaagaagcacaggtgagcaacccaccatacgttcatttgcaccacctgatgattaaaagccaaagaaagaaaaaaaaaaaagaaacaggcggtgggaattgttacaacccacgcgaacccgaaaatggagcaatcttccccggggcctccaaataccaactcacccgagagagagaaagagacaccacccaccacgagacggagtatatccaccaaggtaagtaactcagggttaatgatacaggtgtacacagctccttccctagccattgagtgggtatcacatgacactggcaggttacaaccacgtttagtagttattttgtgcaattccatggggatcaggaagtttggtttggtgggtgcgtctactgattcccctttgtctctgaaaatcttttccctagtggaacactttggctgaatgatataaattcaccttgattcccaccctcccttctttctctctctctctgttacacccaattgaattttcttttttttttttttactttccctccttctttatcatcaaagataagtaagtttatcaattgcctattcaga

SEQ ID NO: 115 - DNA, 351 bp, Artificial Sequence
  Description of Artificial Sequence: Synthetic polynucleotide
aaagtacggtgttgttgacaagttgtcccacgtttctaccggtggtggtgcttctttggaattgttagaaggtaaggaattgccaggtgtgactgctctttccaacaaggcctaaatcagaaatatttattctaataaataggatgcaaaaaaaaaaccccccttaataaaaaaaaaagaaacgattttttatctaatgaagtctatgtatctaacaaatgtatgtatcaatgtttattccgttaaacaaaaatcagtctgtaaaaaaggttctaaataaatattctgtctagtgtacacattctcccaaaatagtgaaatccagctctacaatttagctctaccagtaca

SEQ ID NO: 116 - DNA, 184 bp, Candida viswanathii
gaatagaagagagtgactcttttgataagagtcgcaaatttgatttcataagtatatattcattatgtaaagtagtaaatggaaaattcattaaaaaaaaagcaaatttccgttgtatgcatactccgaacacaaaactagccccggaaaaacccttagttgatagttgcgaatttaggtcgac

SEQ ID NO: 117 - DNA, 531 bp, Artificial Sequence
  Description of Artificial Sequence: Synthetic polynucleotide
gagctccaattgtaatatttcgggagaaatatcgttggggtaaaacaacagagagagagagggagagatggttctggtagaattataatctggttgttgcaaatgctactgatcgactctggcaatgtctgtagctcgctagttgtatgcaacttaggtgttatgcatacacacggttattcggttgaattgtggagtaaaaattgtctgagttgtgtcttagctactggctggccccccgcgaaagataatcaaaattacacttgtgaatttttgcacacacaccgattaacatttcccttttttgtccaccgatacacgcttgcctcttcttttttttctctgtgcttccccctcctgtgactttttccaccattgatataaaatcaactccatttccctaaaatctccccagattctaaaaacaacttcttctcttctgcttttcctttttttttgttatatttatttaccatcccttttttttgaatagttattccccactaacattgttcaaatcttcacgacata

SEQ ID NO: 118 - DNA, 745 bp, Artificial Sequence
  Description of Artificial Sequence: Synthetic polynucleotide
aaaatcagaggctactccggagatggcacattatcacgtgggcagtcccatctctctgacaatggcactgacaatgccatgtcattctagaagtcgctcgttccattgctagtcgtgtaggtgtcttactcagaccatatgtttggctgtgtgtgtggtaagggggtaagatatctctaggaggaggcaactctactcgaaagtacgaaatggccgacgccaatccgacctgccattgtgcaggacgcgggtcgagatccggaagtgccctccttctgaggttgttggtttgttccagttggcataagaaattaataatcgtttagtcaatggtacagtattaataattcctgacaaaaccgtgccctacaagcagtgtgagttccgggggtagcactagtggtcgtggtggtagggcccacagagagtatttccggaaccgactgatcctttgattccaatattccaagatttgggtttgtggttgtgtgtaatgcatgaggttattttgtcaacctccttccttctctacggttgttgctcctcctcctcttccttccctttgttcatttaaatacacacacaccactccccttcccacccacaagaactttttttttttttactttcttcttctcttactttcttcttcttctttcattacctgttagattatatttatcaacctcaattggtttattatctaccacccatacaacccccacccctgccacatccaccaaca

SEQ ID NO: 119 - DNA, 614 bp, Candida viswanathii
cggaagttgtttaccgacctgaccgtaaatttgctgctgaaagaaacgtgtcaaacaagaccaattggctcaattgaccctgtggaaatgctttgttgaccaccaatgcttccaccaaacgttactttttttttgcaatcggatggtatgggtctggggttcacctgttttgtaaagctacagaaggtggcatatttctctgatcaggtgttttttttttcggctgctgctgctcgtggtggtgtagtggtagtggtgtgtgtgtgtgtgtgtgcgtgcgtgtggaaggacgctttttgctctctgactcctcccaatcagaagttgctatagtggtgaaacaacaatggatgataatgccccgggcggtgcgtgtccgacacaaaccactacattttttagctgggagcctactgccactacgacccacccacccatggtcaacaaaaaaattctgacaaattataaaataacccttgaattcccccttggaaaaatttttggtatttctctctctcttttcctttccctcttctttttctctccatcaatcaattgacgttcagtaactcaattaattacatcacatccctcaattaaagaatttaatcgat

SEQ ID NO: 120 - DNA, 500 bp, Candida viswanathii
ctagcaaaggcttgatcagagaaagcaacaaaaaaaaaaactctaatactccagaatacactcctttagaaacacacaacaaacaagcctagactaccatggactacgatgaagacgatttagattacatttctcaaggagaagaggaagagtttgacgaaaacaagttgaacaacgaagagtacgacttgttgcatgacatgcttccggagttgaagacaaaattgaaagattacaatgatgagatcccagattacgatttaaaggaagcgttatactacaactatttcgagatagaccctaccattgaagaattgaagacgaaattcaaaaagagtacgtatatacaactaacatcaacgcctttctagtttctgttctgtctccaatgcttctcctggtttcttcatggttctctctgtaccaacaaggaaaaaaaaaaaaatctggcaaaaaaaaccaaaccaaccaatgttcttactcaccaacgccctacaatc

SEQ ID NO: 121 - DNA, 536 bp, Candida viswanathii
gaagatgaagcgtatgagtattatgagtactgtcggacgttggaaggtggcagagttaagcccgagaaagcaaggaaggagtgggagatgatgagtgatgcggccaaagaggatgtgaaggctgcgtatctgtttttgatagctggtggtagccgaatagaggaaggcaagcttgttcatattggatgatgatggtagatggtggctgccaaagtggttgtaaatagaaaaaagtgggtttgggtctgttgatagttagtggtggcggctgtctgtgattacgtcagcaagtagcacctcggcagttaaaacagcagcaacagaaaaaaaatgtgtgaaagtttgattcccccacagtctaccacacccagagttccatttatccataatatcacaagcaatagaaaaataaaaaattatcaacaaatcacaacgaaaagattctgcaaaattattttcacttcttcttttgacttcctcttcttcttgttaggttctttccatattttccccttaaacccatacacaacgcagcc

SEQ ID NO: 122 - DNA, 8006 bp, Artificial Sequence
  Description of Artificial Sequence: Synthetic polynucleotide
cgaattccagcacactggcggccgttactagtggatccgagctcggtaccaagcttgatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccccatgctcgagagtgctccgaaaatacctcaagggtggttagagttacatgataaacaacaggccaaaaaaagagagggcgtttctcatagaggggtttttctttcgttcaaatctaggggggttgagaggcggaagtcctggcggaacagaagtgagctgggtaatcatacatctcaagtaatgttgcataccggagagaagaaaaaacttggccctcttctctggctgaggagtaaactagaggacggcaggtcggatagtttttttttgactgtcgtagctattgcctatggccagcaccagcaccatcacaaactccagctctcgttgacacacctgcccgcgagcatgcggcccatgcagcggaaaagagacctctttgacggaaatatgtcttagggggtgttttcttactggggggttggtaggacttcggaaacacggagtcctcttcttcggaacgcccccctggttgccggccggttcgtcgcttgatccccctgcaggaaaatcagaggctactccggagatggcacattatcacgtgggcagtcccatctctctgacaatggcactgacaatgccatgtcattctagaagtcgctcgttccattgctagtcgtgtaggtgtcttactcagaccatatgtttggctgtgtgtgtggtaagggggtaagatatctctaggaggaggcaactctactcgaaagtacgaaatggccgacgccaatccgacctgccattgtgcaggacgcgggtcgagatccggaagtgccctccttctgaggttgttggtttgttccagttggcataagaaattaataatcgtttagtcaatggtacagtattaataattcctgacaaaaccgtgccctacaagcagtgtgagttccgggggtagcactagtggtcgtggtggtagggcccacagagagtatttccggaaccgactgatcctttgattccaatattccaagatttgggtttgtggttgtgtgtaatgcatgaggttattttgtcaacctccttccttctctacggttgttgctcctcctcctcttccttccctttgttcatttaaatacacacacaccactccccttcccacccacaagaactttttttttttttactttcttcttctcttactttcttcttcttctttcattacctgttagattatatttatcaacctcaattggtttattatctaccacccatacaacccccacccctgccacatccaccaacaatggacgacgttgattctgctttagccgataatgttaaatccttcgctgccggtggttttggtggtatttgtgccgtgttgaccggtcatccattcgacttggtcaaggtcagattgcaaactgggttgtacaaatcgtcagtgcaatgtgtcaaagaaacaatagccaaagacgggttgtttgggttatacagaggtgtcttgcctccattgttgggtgtcaccccaatgtttgctgtttccttctggggttacgacgttggtaagaaattggtttcttccttcactggcaaatcagtcgacaagtttgaaatcaaagacatttcgactgccggtttcatcagtgccatcccaaccaccttggttgccgctccattcgaaagagtcaaggtcatgatgcagatccaagaaggtgccaagtccaagtccatgggtgccgttgttgctgaaatgtacagaaccggtggtatcagatccatcttcaagggtactgtggctactttggccagagatggtccaggttctgccttgtatttcgctacttatgaatgggtcaagaaggaattgactgcccctggtgaagacttgtccttgtttgctattaccactgctggtggtttcgctggtattgccatgtggttgggtgttttcccaattgacaccatcaagtctacccagcagtcttccaacgtcaaggtctccattgtgcaggccactaagaacatctacgctaaaggtggtatcaaggctttcttccctggtgttggtcctgccttggccagagctttcccagccaacgctgctaccttcctaggggttgaattggccagaaagttcttggacaaagttatataagagtgactcttttgataagagtcgcaaatttgatttcataagtatatattcattatgtaaagtagtaaatggaaaattcattaaaaaaaaagcaaatttccgttgtatgcatactccgaacacaaaactagccccggaaaaacccttagttgatagttgcgaatttaggtcgaccttggacgcgtgcggccgccagtgtgatggatatctgcagaattcgcccttcccgaaatattacaattggagctccaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctcgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccaaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacacacactagttggtagttctggggactaccggcagcaattccatccgtgcgttatctataatccggatcttgtgaaaaaaaaggaaaaattctatatatagaaaagaaattagatagaagcctggcgagtgtgtttctagaagacttccggattcagatgtcgcatggctgcgatatcacaaaaaaaaaagagagactccaacattacacaaaacgtggtcttccgctcccatatctgattgcggattttagagtgacactcttccctcgttgattatcaatttcgcaactgtaggatgggctggaggtattgttgatgcatgcaccacttatcattgtcggatccactaaccgcgtataatacccacacacacacacacacatacacaaacgcttcgtcacatctctatcggtatgtatggggagagatagaacaggaaagtcatgaggccggccaaggg

SEQ ID NO: 123 - DNA, 7743 bp, Artificial Sequence
  Description of Artificial Sequence: Synthetic polynucleotide
taaacgttgggcaaccttggaggggtgtgctgatgccctttctgtgtatgtttttgtgctaaccattgcgaattgagctgggggtttgatgacgatgatgatggggaggttgatctttgggtttgattttttttttcactttttttttttcttgggagttggggaatggatgagatatctcacgtgactagtatggcaatttattgtataaatctgtattccttactttgtttgttatataatacaaaatacttatttaccttcttcttcttgtttcacctcttcgtttgcttcttcctgtttagcttctggttgaccactttccataaactctttcttcaattgtggataaatctcatccattttatcacatgacgccttgtatatctgtgcattctcagtctggtccaagaacttgatgttctgtaacaccaagatcatgttcttgatcaattcaatacaattctcgttgtacccgtcgcatatggtcgacctaaattcgcaactatcaactaagggtttttccggggctagttttgtgttcggagtatgcatacaacggaaatttgctttttttttaatgaattttccatttactactttacataatgaatatatacttatgaaatcaaatttgcgactcttatcaaaagagtcactctcttctattcttaactggacaagatttcagcagcttcttcggacttttcacctctttctctgacttcaaggtctggacggttcaacatgtcttccaaagccttggagtatggagccttggtgttttctggtgggttcaaagccttgacagtttcgaagtagtgttcgtagacgttaccatcatatctaccaatagcagcattggtcatcatgtcagtcaagttgaaaccatcagtcaaaccaacaacgtttggtctaaccttggcacacaaggctgggaagtgctcggaggaaatctttctgctgacatctggggtaatgataccgtactgcaagaaggtggcaccaaagttggtcaagatccagtcggcatacaagaaacccaaaggtctcaagacttcagaccattctggggtgatacgcttgaagaaaccgtcaatcaagaatctgtgagcgttcaacttggaaaccaaaaccaaacttggaccggtaatgtcgaaacccttgtcttcagcaacagcaccaatgtctctggccaagccggaaagggcgtggtcgaaagccttaaccaacttggctgggtcgtccaagtcggcaacgctggagagaaccaatcccttttgttctggctccttcaacaagtctctaaccattggcttggcaacgttcatggccaagatgttgttgtcaccttcccaggtacattggacaacccagtcggagtaggctttaccgaaaccgttgtaagacgagtaaccgtgaccaccacaagcttgacgagcttcgtcaatggcttcagcagtcaaccaggtacaggtggacttcaaacaaccggaagcgacgaacaatttcttggattcgacaatggcagcgtcaatggcttccttttcaccagcactgacagcttcgtccaacttgtcgttggttgcgttcatggtttgttctaagtacaaggcaccttgggagaacaagtaagcggcagccaagaatgggaacaatctcttttgatgcaatgggtagtcaatcaacttggtttcaatggtatcggtgtccttcttcttgaattgtcttctgtggatggcgtatctcaaggcaatggtgatgaatctactggtcattctgtaggagtccatcatcatggtgactctaccaccaatcaaagccgagtaagacaattgttcagatggtggcatggtgacttcacccagacgggaaaccttacagtacttttgcaacataaagaatcttgggattctgacgttggagaactggatccaaccgttatcgataccgtctctacccatcttggcaccaatgtcaccaacagtcacacctggctcgaggtcgtggttggagtctctcaatgggacaacaaaggtcttgacaccgtagtcctttcctttgaccttcaatctggcgtagacggagcagtgggtggcggagtgcgcagcaccaccgatccaccacttggtggcaccaatgtgtggggtgttgatgacaaactcgtcagtgtcttcgtcaaaagtggcggtggtttcaataccttggacgttggaaccgtgggccaactcagtcataccaaaacaaccatagatacctctcaacttgtcgatacccttatttatggtccagtagaagaactgggagttggtaccgttaccacggacacaggaaacaaacaaacccaagttgacaccgattctggttccgacttgtgggtcaaagacaccgaggatcgacaatctctgggcctgttggtctgggtactcgtgctcaaagtatctggagagtctggcaatcttcttggcggtgacttctctttgttggtctttggtcaagttgtagtatgaagcgtcgaccttcaagatagggtctttttgcatttgttcgaccatgttgctgatgatctcggatctttcttgggaaccttccaagaagtagttcaactcctttgggttgaacttggtgagttctctttctttttgaagttcggtaggcattatgtcgtgaagatttgaacaatgttagtggggaataactattcaaaaaaaagggatggtaaataaatataacaaaaaaaaaggaaaagcagaagagaagaagttgtttttagaatctggggagattttagggaaatggagttgattttatatcaatggtggaaaaagtcacaggagggggaagcacagagaaaaaaaagaagaggcaagcgtgtatcggtggacaaaaaagggaaatgttaatcggtgtgtgtgcaaaaattcacaagtgtaattttgattatctttcgcggggggccagccagtagctaagacacaactcagacaatttttactccacaattcaaccgaataaccgtgtgtatgcataacacctaagttgcatacaactagcgagctacagacattgccagagtcgatcagtagcatttgcaacaaccagattataattctaccagaaccatctctccctctctctctctgttgttttaccccaacgatatttctcccgaaatattacaattggagctcctgcaggcatgatgatctgccatgccgaactagacgaagccgttcttcaaggtgtattacaactcgtacgtggataccttcaagcaagtgatgcggatgaagcaaagggcgaatgtgacgtggtttgaggcggcgtactctgggtttgtcaggaacgcactaaccaccatccctgctacatccattgcgttattggttttcgaaatcatgagaactaaactagcagacaacttcgaagactacaatgacgtcctagaagcttagtgtatgtatatagacctatttattacaatatttattctaactgaccagttctcttcaagtatgccttccatccagcatccctgtatctctttccctccacctcagggtctcttccttttccaaacaaccctctcccgacaataatcacatcggtaccagtcagaaccacctcatcaacagtcctatactgctggcccaacgcatcgcctttatcatccaaccccacaccaggcgtcatgatgatccaatcaaacccttcttctctaccccccatgtcccgctgcgcgatgaacccaatcacgaactcccgatcactcttcgcaatctcgatcgtctcacgggtatattcaccatgcgccaacgagcctttactcgacaactccgccaacatcaacacgcccctttccttttctaccccctccgcaccgcgtttcaacccttcaacgacgcccttcccagtcactccgtgcgcgttcgtgatgtcactccacgccgcgatccggtatacccccgaggtgtactgcaacatcacggtgtttccgatatcagcaaacttcctgtcctcgaatatcaagaacccgtggcgctctgcaagcacaagcaacggctcaatcgtgccctcgtagctgaagtctgagatgatatcgatgtgcgtcttcacgagacagatgtggggaccgagcttgtcgatgagcgaaaggaactcggcggttgtggtcacgtcgatcgaggcgcagaggttggtctttttggactccattaagcggaaaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgccctt

SEQ ID NO: 124 - DNA, 6826 bp, Artificial Sequence
  Description of Artificial Sequence: Synthetic polynucleotide
ttccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctagttcggcatggcagatcatcatgcctgcagaaaatcagaggctactccggagatggcacattatcacgtgggcagtcccatctctctgacaatggcactgacaatgccatgtcattctagaagtcgctcgttccattgctagtcgtgtaggtgtcttactcagaccatatgtttggctgtgtgtgtggtaagggggtaagatatctctaggaggaggcaactctactcgaaagtacgaaatggccgacgccaatccgacctgccattgtgcaggacgcgggtcgagatccggaagtgccctccttctgaggttgttggtttgttccagttggcataagaaattaataatcgtttagtcaatggtacagtattaataattcctgacaaaaccgtgccctacaagcagtgtgagttccgggggtagcactagtggtcgtggtggtagggcccacagagagtatttccggaaccgactgatcctttgattccaatattccaagatttgggtttgtggttgtgtgtaatgcatgaggttattttgtcaacctccttccttctctacggttgttgctcctcctcctcttccttccctttgttcatttaaatacacacacaccactccccttcccacccacaagaactttttttttttttactttcttcttctcttactttcttcttcttctttcattacctgttagattatatttatcaacctcaattggtttattatctaccacccatacaacccccacccctgccacatccaccaacaatggacgacgttgattctgctttagccgataatgttaaatccttcgctgccggtggttttggtggtatttgtgccgtgttgaccggtcatccattcgacttggtcaaggtcagattgcaaactgggttgtacaaatcgtcagtgcaatgtgtcaaagaaacaatagccaaagacgggttgtttgggttatacagaggtgtcttgcctccattgttgggtgtcaccccaatgtttgctgtttccttctggggttacgacgttggtaagaaattggtttcttccttcactggcaaatcagtcgacaagtttgaaatcaaagacatttcgactgccggtttcatcagtgccatcccaaccaccttggttgccgctccattcgaaagagtcaaggtcatgatgcagatccaagaaggtgccaagtccaagtccatgggtgccgttgttgctgaaatgtacagaaccggtggtatcagatccatcttcaagggtactgtggctactttggccagagatggtccaggttctgccttgtatttcgctacttatgaatgggtcaagaaggaattgactgcccctggtgaagacttgtccttgtttgctattaccactgctggtggtttcgctggtattgccatgtggttgggtgttttcccaattgacaccatcaagtctacccagcagtcttccaacgtcaaggtctccattgtgcaggccactaagaacatctacgctaaaggtggtatcaaggctttcttccctggtgttggtcctgccttggccagagctttcccagccaacgctgctaccttcctaggggttgaattggccagaaagttcttggacaaagttatataataagaatagaagagagtgactcttttgataagagtcgcaaatttgatttcataagtatatattcattatgtaaagtagtaaatggaaaattcattaaaaaaaaagcaaatttccgttgtatgcatactccgaacacaaaactagccccggaaaaacccttagttgatagttgcgaatttaggtcgaccatatgcgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccaaggttgcccaacgtttaaagggcgaattccagcacactggcggccgttactagtggatccgagctcggtaccaagcttgatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcgccctt

SEQ ID NO: 125 - DNA, 446 bp, Artificial Sequence
  Description of Artificial Sequence: Synthetic polynucleotide
tcatgactttcctgttctatctctccccatacataccgatagagatgtgacgaagcgtttgtgtatgtgtgtgtgtgtgtgtgggtattatacgcggttagtggatccgacaatgataagtggtgcatgcatcaacaatacctccagcccatcctacagttgcgaaattgataatcaacgagggaagagtgtcactctaaaatccgcaatcagatatgggagcggaagaccacgttttgtgtaatgttggagtctctcttttttttttgtgatatcgcagccatgcgacatctgaatccggaagtcttctagaaacacactcgccaggcttctatctaatttcttttctatatatagaatttttccttttttttcacaagatccggattatagataacgcacggatggaattgctgccggtagtccccagaactaccaactagtgt

SEQ ID NO: 126 - DNA, 500 bp, Artificial Sequence
  Description of Artificial Sequence: Synthetic polynucleotide
ggatcaagcgacgaaccggccggcaaccaggggggcgttccgaagaagaggactccgtgtttccgaagtcctaccaaccccccagtaagaaaacaccccctaagacatatttccgtcaaagaggtctcttttccgctgcatgggccgcatgctcgcgggcaggtgtgtcaacgagagctggagtttgtgatggtgctggtgctggccataggcaatagctacgacagtcaaaaaaaaactatccgacctgccgtcctctagtttactcctcagccagagaagagggccaagttttttcttctctccggtatgcaacattacttgagatgtatgattacccagctcacttctgttccgccaggacttccgcctctcaacccccctagatttgaacgaaagaaaaacccctctatgagaaacgccctctctttttttggcctgttgtttatcatgtaactctaaccacccttgaggtattttcggagcactctcgagcatgg

SEQ ID NO: 127 - DNA, 9522 bp, Artificial Sequence
  Description of Artificial Sequence: Synthetic polynucleotide
  modified_base (3519)..(3519): a, c, t, g, unknown or other
  modified_base (3663)..(3663): a, c, t, g, unknown or other
  modified_base (3919)..(3919): a, c, t, g, unknown or other
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattccggttgaattgtggagtaaaaattgtctgagttgtgtcttagctactggctggccccccgcgaaagataatcaaaattacacttgtgaatttttgcacacacaccgattaacatttcccttttttgtccaccgatacacgcttgcctcttcttttttttctctgtgcttccccctcctgtgactttttccaccattgatataaaatcaactccatttccctaaaatctccccagattctaaaaacaacttcttctcttctgcttttcctttttttttgttatatttatttaccatcccttttttttgaatagttattccccactaacattgttcaaatcttcacgacataatgacttttacaaagaaaaacgttagtgtatcacaaggtcctgaccctagatcatccatccaaaaggaaagagacagctccaaatggaaccctcaacaaatgaactacttcttggaaggctccgtcgaaagaagtgagttgatgaaggctttggcccaacaaatggaaagagacccaatcttgttcacagacggctcctactacgacttgaccaaggaccaacaaagagaattgaccgccgtcaagatcaacagaatcgccagatacagagaacaagaatccatcgacactttcaacaagagattgtccttgattggtatctttgacccacaggtcggtaccagaattggtgtcaacctcggtttgttcctttcttgtatcagaggtaacggtaccacttcccaattgaactactgggctaacgaaaaggaaaccgctgacgttaaaggtatctacggttgtttcggtatgacccccggggatctgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccnaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatntcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgtnggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctacggtcgacgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcagagctcggtacccggggatcctctagagtcgacctgcaggcatgctaatgtttatatcgttgacggtgaaaaattttaacttacttgtaatatttacgatttggacttgaagtccaaaatgaagtataaatattggttgaaaattgaaaatgatttacaagccatatacaatagttccaatccaaattggagatattgtactaaatatccaggcagaaccaacaacaacaatgacgacaaagtgcaagccaaagagtagaaatcattaatctttcatattgtcattttttttattattattcagtacatatatacatatgtgtcaactatatatttcatgaaatatacatacgtcaaataaaacatatcccaatcactaaaaaaaaaaaaaatattaaccaaaactaatcttaactttaattaaatgttcatattttccttaccagacatcttcttggtatctattttgaactttccaagatttaaccaattcagcagctttatcttcgtggatatctctacttttggcaacaatcttggcaattgcagcttgaacatctctagccattctactggcatcaccacaaacataaataattgctccactagataataactcatcaacaagagcactattttctaaaatcttatcttgaacataaactttcttagttggatcttgtcttgagaaggcattaaacatttcgaaattttctcccaatactgaggcatattcactccattcttgtttgtacaagaaatcttgttcggaatttctacatccataaaacaatacagtcttaccaacattaacaccatttttaacttgttgaactctttctctaacaaaacctctcaatggtgcaacaccggtacctggaccaatcaaaataactggggtagtgctattctttggtaatttgaaattagatcttctaacgtgaactggcaatctgaacttgctaaatttgcctcttggaccattcaaatcataatgaaccattggggtttcaccagttttgttttgttcaatttcaatattcttcaacaagttggtgacaacaccagtaactggtcttccatcagcttcttcttcggcttcaacaacagcagtaacattaatggtttgcttttcacttaatgaggaagaagaaatggagtaataacgaggagttaagtgttggacattttcaataaggaattcgaatggaacatcggaccatggtctgttgttggaagcaaataataaagcatcggcaatgttgaattttctacgggtgactttactagcaaattcttgcttatcaccaccaattctagtaaatgactttttagtttcttcatcaggggcaaatccagcaatagataagaaaaattgtctagaaacaggacctgaaatttccaaatggtgtctaataacagctccataagtgattggattagggaatgggatggaataagtggaatccaaagctttcaattcaataacagtatcaagtttgtcttctaaaccaaaacatttggcaaattgcttaatgttttcatcagagttagatggccagattgcaagatgatcaccggtggtatatttcaagtttgattcagaaatatcaaattcaacatgaacacaatgtctgtcttcagaagtaaacaattctttagttttaacaattctagccaaaaatggatgagtatgatcaaatggacctttagttaagtcaacaccttcagatttaatgtatttgacatttggttcacccaaggagacatctggatcattgccagataaatcatctctttcagtcaatttaacatttggttcgtatttcaactctttttcttcaaaattcaaatcattctttaaggaatcaaacacgttatccttccaggccaagaaatcttcatctaaagtaccagtaccatcgtcaccttcaccgtattcagcaaatctgtcaccacctttttctcccaacaatctgtcaaattttctaccaatagcattgaagaattcataagttgaattacccaaaccaaaaacagtatatttcaaagtactcaaggtgtcagcttcttcagtcaaccaagtgtgaaattcgtcagcattatcggttggttcaccttcaccataagtagcaacaataaagaaaaccaagatatcttcagtaatatctccgaagttttcgaaatcataatcagcgaaatcagcaaccatggttttcaaaccaaatcttgaatgcaattctcttgacaatttgttggcataatcttctgctgtacctgtttgggatccaaataataataacgtatttttattgttcttcttcaaagcttgtaagatatctcttgaattaccatctccactatcagtattaaggaacccggtatcttgttgttggtcaagaaactgattctttgcaaaataagctgcaattgcaaccaccaatgttataataacatataaatctaacttatctaatgccatgacttgagcgattgaaacaatagtcttagttgatagagcagtaatggatcaagaaaagaaaaagaataaaaggtagaaataaaaaaaaaacaaagaaaaattggaaatttgaaatgtttaaaatctttttttttattttttctctcgttcagttcgtttgaagattgtcgtatgaaattttttattcttttttttttttgttcctcttctgatgttcaattacgggacccaacgtcgtttatgtattacgatactgggaccatactgactttgaaatatgtatcatttctgacagtcaggtaatgtgtaccaacttagaccaaatttcatctctataattattattgtatatataactgtcctttcttttcgtctattagagttttatctcaggaggatttatcggtgcaatttcgatatcggatcatttattcactaagagctagagtgagacaaaagcagaatgctacaccgaccaccgctaccaccaccattatttttggggttttactctacgcaaccccccccatcgaagcattgaatagacatgacagctcttccgcttcctcgctcactgactcgctgcgctcggtcgttcggctgcggcgagcggtatcagctcactcaaaggcggtaatacggttatccacagaatcaggggataacgcaggaaagaacatggacgctgccgttgaaaagaacgacaccaaggctatctttaagtctattgacgacatgaagtcattgtttgttgactctggttccttgaagtccactgccacttggttgggtgctgaagccattgaccaatgtagacaagcctgtggtggtcacggttactcgtcctacaacggcttcggtaaagcctacaacgattgggttgtccaatgtacttgggaaggtgacaacaatgtcttggccatgagtgttggtaagccaattgtcaagcaagttatcagcattgaagatgccggcaagaccgtcagaggttccaccgctttcttgaaccaattgaaggactacactggttccaacagctccaaggttgttttgaacactgttgctgacttggacgacatcaagactgtcatcaaggctattgaagttgccatcatcagattgtcccaagaagctgcttctattgtcaagaaggaatctttcgactatgtcggcgctgaattggttcaactctccaagttgaaggctcaccactacttgttgactgaatacatcagaagaattgacacctttgaccaaaaggacttggttccatacttgatcaccctcggtaagttgtacgctgccactattgtcttggacagatttgccggtgtcttcttgactttcaacgttgcctccaccgaagccatcactgctttggcctctgtgcaaattccaaagttgtgtgctgaagtcagaccaaacgttgttgcttacaccgactccttccaacaatccgacatgattgtcaattctgctattggtagatacgatggtgacatctatgagaactactttgacttggtcaagttgcagaacccaccatccaagaccaaggctccttactctgatgctttggaagccatgttgaacagaccaaccttggacgaaagagaaagatttgaaaagtctgatgaaaccgctgctatcttgtccaagaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtt

SEQ ID NO: 128 - DNA, 5570 bp, Artificial Sequence
  Description of Artificial Sequence: Synthetic polynucleotide
ggccgcgagcactaggttttgataatttggttcttacagtttatgtattttgattcttccttttttagatacttttttttatattttattattccttattgatgtaacgacagtcccactataattaacttaaactttgctgtaaatcagatgacaagtgtttccctgtttgcaggggagctctactagtttccttaattcatcttggttatgttgttcttgcaccgcaaggataagctgggcccgaatccaggccacgcataccaactatcgctgcccggaaaaaatacaaactagtaaactgcaaaaaaccatatataaacaataagaattttctctgtatcattcttcgaaaaacctcaccttctctctctctctctctctcacccttcctttcccctatcacatcttcatcttcacatcaccaactcaaaacccctaagcagccaaagtaaagaacagagaatgattccacaacatcacactatgttcttcgccgttaattaagaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttttaattaaagataatcacaggggtagagaccttggttatgggctgattggaggaagaaatggggtgatttggcacttgacagcgcgagagtggttaacacctggtttccctcatttgggttctgacatttgataagttgaaagaacaatgcagaattcacatggctaatttggcctcggttccacaacgcactcagcattaaaaaaaaaatacgcaatggcagctcggtcgacgcagcagaagcgccgacgtaccgtcgcgttgccccgcccatgcctcgccgacccctccaccgccatcgtttgcccattgtttgtggtagtgcgccgtgacacaaaaacttgtcctgtcacatgctgaagttacaccaacataactactatgggattacgtaatcaaaaatttcacagttttaacaaaaaaaaaatcatacaatcaacattgggacatcttgccctcccccacaaaacttgcttctgcatcaatcatatataaacatcatgaaataagcctaaactcacttctttttttttcatccttcctacttcttctttcatagtaactactttttttttattaccacacttattcattcataccacgctatcggccggccgcatgcggatccgagctcgcggccgccagtgtgatggatatctgcagcggccgctaaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctcgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatacaagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccaaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctgc

SEQ ID NO: 129 - DNA, 32 bp, Artificial Sequence
  Description of Artificial Sequence: Synthetic oligonucleotide
cacacacatatgcgacgggtacaacgagaatt

SEQ ID NO: 130 - DNA, 32 bp, Artificial Sequence
  Description of Artificial Sequence: Synthetic oligonucleotide
cacacaacgcgtagacgaagccgttcttcaag

SEQ ID NO: 131 - DNA, 21 bp, Artificial Sequence
  Description of Artificial Sequence: Synthetic oligonucleotide
atgatctgccatgccgaactc

SEQ ID NO: 132 - DNA, 28 bp, Artificial Sequence
  Description of Artificial Sequence: Synthetic oligonucleotide
agcgagttcggcatggcagatcatcatg

SEQ ID NO: 133 - DNA, 37 bp, Artificial Sequence
  Description of Artificial Sequence: Synthetic oligonucleotide
cacacagctcttctagaatggctttagacaagttaga

SEQ ID NO: 134 - DNA, 43 bp, Artificial Sequence
  Description of Artificial Sequence: Synthetic oligonucleotide
cacacagctcttcgtttccaaacatcttcttggtatctatttt

SEQ ID NO: 135 - DNA, 30 bp, Artificial Sequence
  Description of Artificial Sequence: Synthetic oligonucleotide
cacacactgcaggagctccaattgtaatat

SEQ ID NO: 136 - DNA, 48 bp, Artificial Sequence
  Description of Artificial Sequence: Synthetic oligonucleotide
cacacatctagacccgggctcttcttatgtcgtgaagatttgaacaat

SEQ ID NO: 137 - DNA, 46 bp, Artificial Sequence
  Description of Artificial Sequence: Synthetic oligonucleotide
gagcccgggtctagatgtgtgctcttccgagtgactcttttgataa

SEQ ID NO: 138 - DNA, 37 bp, Artificial Sequence
  Description of Artificial Sequence: Synthetic oligonucleotide
cacacacatatggtcgacctaaattcgcaactatcaa

SEQ ID NO: 139 - DNA, 41 bp, Artificial Sequence
  Description of Artificial Sequence: Synthetic oligonucleotide
cacacagctcttccataatgactgcacaggatattatcgcc

SEQ ID NO: 140 - DNA, 52 bp, Artificial Sequence
  Description of Artificial Sequence: Synthetic oligonucleotide
cacacagctcttccctctcttctattcctaatacatctcaatgttggcaccg

SEQ ID NO: 141 - DNA, 42 bp, Artificial Sequence
  Description of Artificial Sequence: Synthetic oligonucleotide
cacacagctcttccataatggctttagacaagttagatttgt

SEQ ID NO: 142 - DNA, 47 bp, Artificial Sequence
  Description of Artificial Sequence: Synthetic oligonucleotide
cacacagctcttccctctcttctattcctaccaaacatcttcttggt

SEQ ID NO: 143 - DNA, 21 bp, Artificial Sequence
  Description of Artificial Sequence: Synthetic oligonucleotide
ttccgcttaatggagtccaaa

SEQ ID NO: 144 - DNA, 40 bp, Artificial Sequence
  Description of Artificial Sequence: Synthetic oligonucleotide
atgatctgccatgccgaactagacgaagccgttcttcaag

SEQ ID NO: 145 - DNA, 40 bp, Artificial Sequence
  Description of Artificial Sequence: Synthetic oligonucleotide
cttgaagaacggcttcgtctagttcggcatggcagatcat

SEQ ID NO: 146 - DNA, 20 bp, Artificial Sequence
  Description of Artificial Sequence: Synthetic oligonucleotide
taaacgttgggcaaccttgg

SEQ ID NO: 147 - DNA, 40 bp, Artificial Sequence
  Description of Artificial Sequence: Synthetic oligonucleotide
aaaatcagaggctactccggagatggcacattatcacgtg

SEQ ID NO: 148 - DNA, 41 bp, Artificial Sequence
  Description of Artificial Sequence: Synthetic oligonucleotide
tgttggtggatgtggcaggggtgggggttgtatgggtggta

SEQ ID NO: 149 - DNA, 59 bp, Artificial Sequence
  Description of Artificial Sequence: Synthetic oligonucleotide
ccggttcgtcgcttgatccaaaatcagaggctactccggagatggcacattatcacgtg

SEQ ID NO: 150 - DNA, 51 bp, Artificial Sequence
  Description of Artificial Sequence: Synthetic oligonucleotide
cgtcgtccattgttggtggatgtggcaggggtgggggttgtatgggtggta

SEQ ID NO: 151 - DNA, 41 bp, Artificial Sequence
  Description of Artificial Sequence: Synthetic oligonucleotide
agagtcactcttatataactttgtccaagaactttctggcc

SEQ ID NO: 152 - DNA, 27 bp, Artificial Sequence
  Description of Artificial Sequence: Synthetic oligonucleotide
caccaacaatggacgacgttgattctg

SEQ ID NO: 153 - DNA, 42 bp, Artificial Sequence
  Description of Artificial Sequence: Synthetic oligonucleotide
actggcggccgcacgcgtccaaggtcgacctaaattcgcaac

SEQ ID NO: 154 - DNA, 32 bp, Artificial Sequence
  Description of Artificial Sequence: Synthetic oligonucleotide
aagttatataagagtgactcttttgataagag

SEQ ID NO: 155 - DNA, 18 bp, Artificial Sequence
  Description of Artificial Sequence: Synthetic oligonucleotide
cttggacgcgtgcggccg

SEQ ID NO: 156 - DNA, 18 bp, Artificial Sequence
  Description of Artificial Sequence: Synthetic oligonucleotide
ggatcaagcgacgaaccg

SEQ ID NO: 157 - DNA, 43 bp, Artificial Sequence
  Description of Artificial Sequence: Synthetic oligonucleotide
cacacagctcttccataatgtttaactttaagttgtcgcaaca

SEQ ID NO: 158 - DNA, 53 bp, Artificial Sequence
  Description of Artificial Sequence: Synthetic oligonucleotide
cacacagctcttccctctcttctattcttacaacttaggcttagcatcagtca

SEQ ID NO: 159 - DNA, 20 bp, Artificial Sequence
  Description of Artificial Sequence: Synthetic oligonucleotide
ccaccaaatccattatgcca

SEQ ID NO: 160 - DNA, 48 bp, Artificial Sequence
  Description of Artificial Sequence: Synthetic oligonucleotide
ccgaaacaaccgtagatacctttaatgggttacccttgatgacttctg

SEQ ID NO: 161 - DNA, 48 bp, Artificial Sequence
  Description of Artificial Sequence: Synthetic oligonucleotide
cagaagtcatcaagggtaacccattaaaggtatctacggttgtttcgg

SEQ ID NO: 162 - DNA, 40 bp, Artificial Sequence
  Description of Artificial Sequence: Synthetic oligonucleotide
gatttcttcgtcgtgggcagggtaccgagctctgcgaatt

SEQ ID NO: 163 - DNA, 40 bp, Artificial Sequence
  Description of Artificial Sequence: Synthetic oligonucleotide
aattcgcagagctcggtaccctgcccacgacgaagaaatc

SEQ ID NO: 164 - DNA, 20 bp, Artificial Sequence
  Description of Artificial Sequence: Synthetic oligonucleotide
agtaagccaaaccgaaaccg

SEQ ID NO: 165 - DNA, 44 bp, Artificial Sequence
  Description of Artificial Sequence: Synthetic oligonucleotide
aattcgcagagctcggtacccaacaagttgttgtaggcactcaa

SEQ ID NO: 166 - DNA, 44 bp, Artificial Sequence
  Description of Artificial Sequence: Synthetic oligonucleotide
ttgagtgcctacaacaacttgttgggtaccgagctctgcgaatt

SEQ ID NO: 167 - DNA, 47 bp, Artificial Sequence
  Description of Artificial Sequence: Synthetic oligonucleotide
gacgaagaattccaaaggcttgttaaaggtatctacggttgtttcgg

SEQ ID NO: 168 - DNA, 47 bp, Artificial Sequence
  Description of Artificial Sequence: Synthetic oligonucleotide
ccgaaacaaccgtagatacctttaacaagcctttggaattcttcgtc

SEQ ID NO: 169 - DNA, 54 bp, Artificial Sequence
  Description of Artificial Sequence: Synthetic oligonucleotide
aaagaaagaaagaaactataacaatcaatcatgccaattttgaaaaaaccattc

SEQ ID NO: 170 - DNA, 53 bp, Artificial Sequence
  Description of Artificial Sequence: Synthetic oligonucleotide
tcttatcaaaagagtcactctcttctattcttacaacttaggcttagcatcag

SEQ ID NO: 171 - DNA, 24 bp, Artificial Sequence
  Description of Artificial Sequence: Synthetic oligonucleotide
gaatagaagagagtgactcttttg

SEQ ID NO: 172 - DNA, 27 bp, Artificial Sequence
  Description of Artificial Sequence: Synthetic oligonucleotide
gattgattgttatagtttctttctttc

SEQ ID NO: 173 - DNA, 42 bp, Artificial Sequence
  Description of Artificial Sequence: Synthetic oligonucleotide
ttgactgatgctaagtaagaatagaagagagtgactcttttg

SEQ ID NO: 174 - DNA, 41 bp, Artificial Sequence
  Description of Artificial Sequence: Synthetic oligonucleotide
tctcttctattcttacttagcatcagtcaataatcccttag

SEQ ID NO: 175 - DNA, 58 bp, Artificial Sequence
  Description of Artificial Sequence: Synthetic oligonucleotide
aaaagaaagaaagaaactataacaatcaatcaatgtttaactttaagttgtcgcaaca

SEQ ID NO: 176 - DNA, 56 bp, Artificial Sequence
  Description of Artificial Sequence: Synthetic oligonucleotide
tcaaaagagtcactctcttctattcttacttagcatcagtcaataatcccttagtc

SEQ ID NO: 177 - DNA, 33 bp, Artificial Sequence
  Description of Artificial Sequence: Synthetic oligonucleotide
gaatagaagagagtgactcttttgataagagtc

SEQ ID NO: 178 - DNA, 33 bp, Artificial Sequence
  Description of Artificial Sequence: Synthetic oligonucleotide
tgattgattgttatagtttctttctttcttttg

SEQ ID NO: 179 - DNA, 52 bp, Artificial Sequence
  Description of Artificial Sequence: Synthetic oligonucleotide
aaagaaagaaagaaactataacaatcaatcatgtcaacttaccagttccaag

SEQ ID NO: 180 - DNA, 52 bp, Artificial Sequence
  Description of Artificial Sequence: Synthetic oligonucleotide
tcttatcaaaagagtcactctcttctattcctaatactcgcttaatctcaac

SEQ ID NO: 181 - DNA, 33 bp, Artificial Sequence; identical to SEQ ID NO: 178
  Description of Artificial Sequence: Synthetic oligonucleotide

SEQ ID NO: 182 - DNA, 30 bp, Artificial Sequence
  Description of Artificial Sequence: Synthetic oligonucleotide
tcaacttaccagttccaagaaactttagaa

SEQ ID NO: 183 - DNA, 59 bp, Artificial Sequence
  Description of Artificial Sequence: Synthetic oligonucleotide
caaaagaaagaaagaaactataacaatcaatcaatgctttcccgtaccactttaagagt

SEQ ID NO: 184 - DNA, 51 bp, Artificial Sequence
  Description of Artificial Sequence: Synthetic oligonucleotide
ttctaaagtttcttggaactggtaagttgattggtcggtcttgctgttgaa

SEQ ID NO: 185 - DNA, 59 bp, Artificial Sequence
  Description of Artificial Sequence: Synthetic oligonucleotide
caaaagaaagaaagaaactataacaatcaatcaatgtctgcattaagatcattccaacg

SEQ ID NO: 186 - DNA, 59 bp, Artificial Sequence
  Description of Artificial Sequence: Synthetic oligonucleotide
ttctaaagtttcttggaactggtaagttgaataggttctgactgagttctttaaggtgg

SEQ ID NO: 187 - DNA, 59 bp, Artificial Sequence
  Description of Artificial Sequence: Synthetic oligonucleotide
caaaagaaagaaagaaactataacaatcaatcaatgtttaactttaagttgtcgcaaca

SEQ ID NO: 188 - DNA, 48 bp, Artificial Sequence
  Description of Artificial Sequence: Synthetic oligonucleotide
ttctaaagtttcttggaactggtaagttgaaccctttgcgtggctggt

SEQ ID NO: 189 - DNA, 36 bp, Artificial Sequence
  Description of Artificial Sequence: Synthetic oligonucleotide
atggacgacgttgattctgctttagccgataatgtt

SEQ ID NO: 190 - DNA, 31 bp, Artificial Sequence
  Description of Artificial Sequence: Synthetic oligonucleotide
ttatataactttgtccaagaactttctggcc

SEQ ID NO: 191 - DNA, 20 bp, Artificial Sequence
  Description of Artificial Sequence: Synthetic oligonucleotide
ttgtttctttgacacattgc

SEQ ID NO: 192 - DNA, 18 bp, Artificial Sequence
  Description of Artificial Sequence: Synthetic oligonucleotide
tgctattaccactgctgg

SEQ ID NO: 193 - DNA, 37 bp, Artificial Sequence
  Description of Artificial Sequence: Synthetic oligonucleotide
caatgtgtcaaagaaacaaggtaccgagctctgcgaa

SEQ ID NO: 194 - DNA, 41 bp, Artificial Sequence
  Description of Artificial Sequence: Synthetic oligonucleotide
cagcagtggtaatagcattaaaggtatctacggttgtttcg

SEQ ID NO: 195 - DNA, 18 bp, Artificial Sequence
  Description of Artificial Sequence: Synthetic oligonucleotide
gtaaccccagaaggaaac

SEQ ID NO: 196 - DNA, 20 bp, Artificial Sequence
  Description of Artificial Sequence: Synthetic oligonucleotide
ttcaagggtactgtggctac

SEQ ID NO: 197 - DNA, 50 bp, Artificial Sequence
  Description of Artificial Sequence: Synthetic oligonucleotide
gtttgctgtttccttctggggttacgacgggtacaacgagaattgtattg

SEQ ID NO: 198 - DNA, 43 bp, Artificial Sequence
  Description of Artificial Sequence: Synthetic oligonucleotide
ccaaagtagccacagtacccttgaatgcgaattgagctggggg

SEQ ID NO: 199 - DNA, 36 bp, Artificial Sequence
  Description of Artificial Sequence: Synthetic oligonucleotide
agatcatcatgcctgcagaaaatcagaggctactcc

SEQ ID NO: 200 - DNA, 43 bp, Artificial Sequence
  Description of Artificial Sequence: Synthetic oligonucleotide
gtcactctcttctattcttatataactttgtccaagaactttc

SEQ ID NO: 201 - DNA, 24 bp, Artificial Sequence
  Description of Artificial Sequence: Synthetic oligonucleotide
gaatagaagagagtgactcttttg

SEQ ID NO: 202 - DNA, 19 bp, Artificial Sequence
  Description of Artificial Sequence: Synthetic oligonucleotide
ctgcaggcatgatgatctg

SEQ ID NO: 203 - DNA, 59 bp, Artificial Sequence
  Description of Artificial Sequence: Synthetic oligonucleotide
aaaagaaagaaagaaactataacaatcaatcaatggctccatacctcaaaaaattgaga

SEQ ID NO: 204 - DNA, 59 bp, Artificial Sequence
  Description of Artificial Sequence: Synthetic oligonucleotide
agagtcactctcttctattcctacaacttggcccgtctacctttgttcaacttcatggt

SEQ ID NO: 205 - DNA, 46 bp, Artificial Sequence
  Description of Artificial Sequence: Synthetic oligonucleotide
cacacagctcttccataatgagatgccaagtatctcaaccatcaag

SEQ ID NO: 206 - DNA, 55 bp, Artificial Sequence
  Description of Artificial Sequence: Synthetic oligonucleotide
cacacagctcttccctctcttctattcctagttcaatgatttaaggaacttttcc

SEQ ID NO: 207 - DNA, 32 bp, Artificial Sequence
  Description of Artificial Sequence: Synthetic oligonucleotide
cacacactgcagttgtccaatgtaataatttt

SEQ ID NO: 208 - DNA, 56 bp, Artificial Sequence
  Description of Artificial Sequence: Synthetic oligonucleotide
cacacatctagacccgggctcttcttctgaataggcaattgataaacttacttatc

SEQ ID NO: 209 - DNA, 48 bp, Artificial Sequence
  Description of Artificial Sequence: Synthetic oligonucleotide
gagcccgggtctagatgtgtgctcttccaaagtacggtgttgttgaca

SEQ ID NO: 210 - DNA, 37 bp, Artificial Sequence
  Description of Artificial Sequence: Synthetic oligonucleotide
cacacacatatgaattctgtactggtagagctaaatt

SEQ ID NO: 211 - DNA, 22 bp, Artificial Sequence
  Description of Artificial Sequence: Synthetic oligonucleotide
gctgccagtgttggtgacgact

SEQ ID NO: 212 - DNA, 22 bp, Artificial Sequence
  Description of Artificial Sequence: Synthetic oligonucleotide
ttggacggcgttgtatctggaa

SEQ ID NO: 213 - DNA, 23 bp, Artificial Sequence
  Description of Artificial Sequence: Synthetic oligonucleotide
gctgtttctgacttgtcgtttgt

SEQ ID NO: 214 - DNA, 22 bp, Artificial Sequence
  Description of Artificial Sequence: Synthetic oligonucleotide
tgcagcatgcttcatagtggtc

SEQ ID NO: 215 - DNA, 23 bp, Artificial Sequence
  Description of Artificial Sequence: Synthetic oligonucleotide
gcttttgttgttgattccaagag

SEQ ID NO: 216 - DNA, 22 bp, Artificial Sequence
  Description of Artificial Sequence: Synthetic oligonucleotide
caagtcagaaacagatgcagca

SEQ ID NO: 217 - DNA, 54 bp, Artificial Sequence
  Description of Artificial Sequence: Synthetic oligonucleotide
gctgtttctgacttggcttttgttgttgattccaagagcgaatccacttccaga

SEQ ID NO: 218 - DNA, 22 bp, Artificial Sequence
  Description of Artificial Sequence: Synthetic oligonucleotide
tgcagcatgcttcatagtggtc

SEQ ID NO: 219 - DNA, 50 bp, Artificial Sequence
  Description of Artificial Sequence: Synthetic oligonucleotide
ttcaagttggctcaaatcgcaggtgccagatacaacgccgtccaatctgc

SEQ ID NO: 220 - DNA, 50 bp, Artificial Sequence
  Description of Artificial Sequence: Synthetic oligonucleotide
gcagattggacggcgttgtatctggcacctgcgatttgagccaacttgaa

SEQ ID NO: 221 - DNA, 33 bp, Artificial Sequence
  Description of Artificial Sequence: Synthetic oligonucleotide
ggtgctcgctcattggctgatggtggcttgttg

SEQ ID NO: 222 - DNA, 33 bp, Artificial Sequence
  Description of Artificial Sequence: Synthetic oligonucleotide
caacaagccaccatcagccaatgagcgagcacc

SEQ ID NO: 223 - DNA, 33 bp, Artificial Sequence
  Description of Artificial Sequence: Synthetic oligonucleotide
ctctacgcgttgtactggtagagctaaattgta

SEQ ID NO: 224 - DNA, 21 bp, Artificial Sequence
  Description of Artificial Sequence: Synthetic oligonucleotide
catcatgcctgcaggtcgact

SEQ ID NO: 225 - DNA, 28 bp, Artificial Sequence
  Description of Artificial Sequence: Synthetic oligonucleotide
tcatgactttcctgttctatctctcccc

SEQ ID NO: 226 - DNA, 24 bp, Artificial Sequence
  Description of Artificial Sequence: Synthetic oligonucleotide
ccatgctcgagagtgctccgaaaa

SEQ ID NO: 227 - DNA, 57 bp, Artificial Sequence
  Description of Artificial Sequence: Synthetic oligonucleotide
aaaagaaagaaagaaactataacaatcaatcaatgccagaatcaactcaacaatctc

SEQ ID NO: 228 - DNA, 55 bp, Artificial Sequence
  Description of Artificial Sequence: Synthetic oligonucleotide
gactcttatcaaaagagtcactctcttctattcttatttcttgcaggcatggaca

SEQ ID NO: 229 - DNA, 57 bp, Artificial Sequence
  Description of Artificial Sequence: Synthetic oligonucleotide
aaaagaaagaaagaaactataacaatcaatcaatgactacagactcaaacacccaca

SEQ ID NO: 230 - DNA, 57 bp, Artificial Sequence
  Description of Artificial Sequence: Synthetic oligonucleotide
gactcttatcaaaagagtcactctcttctattcttactttctaccgaattgagcacc

SEQ ID NO: 231 - DNA, 28 bp, Artificial Sequence
  Description of Artificial Sequence: Synthetic oligonucleotide
atgcttacactaacttctggtcccaacc

SEQ ID NO: 232 - DNA, 28 bp, Artificial Sequence
  Description of Artificial Sequence: Synthetic oligonucleotide
gactattgtctctagcggtctagatcct

SEQ ID NO: 233 - DNA, 23 bp, Artificial Sequence
  Description of Artificial Sequence: Synthetic oligonucleotide
cacatcgagccatgattgagaac

SEQ ID NO: 234 - DNA, 21 bp, Artificial Sequence
  Description of Artificial Sequence: Synthetic oligonucleotide
cgtgagcaaacaattggaacg

SEQ ID NO: 235 - DNA, 20 bp, Artificial Sequence
  Description of Artificial Sequence: Synthetic oligonucleotide
atgagtcacccaacgccaga

SEQ ID NO: 236 - DNA, 20 bp, Artificial Sequence
  Description of Artificial Sequence: Synthetic oligonucleotide
tcagagcttcggcgactcag

SEQ ID NO: 237 - DNA, 20 bp, Artificial Sequence
  Description of Artificial Sequence: Synthetic oligonucleotide
accatgacgctgattgcacc

SEQ ID NO: 238 - DNA, 23 bp, Artificial Sequence
  Description of Artificial Sequence: Synthetic oligonucleotide
cgagctacaatttctgcacacct

SEQ ID NO: 239 - DNA, 24 bp, Artificial Sequence
  Description of Artificial Sequence: Synthetic oligonucleotide
atgcccacattcaactacaaggac

SEQ ID NO: 240 - DNA, 22 bp, Artificial Sequence
  Description of Artificial Sequence: Synthetic oligonucleotide
cgctctgttgcaagtatcgtca

SEQ ID NO: 241 - DNA, 24 bp, Artificial Sequence
  Description of Artificial Sequence: Synthetic oligonucleotide
atgtcaaccaccggaatctacaac

SEQ ID NO: 242 - DNA, 28 bp, Artificial Sequence
  Description of Artificial Sequence: Synthetic oligonucleotide
ctacaactttggagttgtgacctgcttc

SEQ ID NO: 243 - DNA, 22 bp, Artificial Sequence
  Description of Artificial Sequence: Synthetic oligonucleotide
cagaccccgaataatggacaaa

SEQ ID NO: 244 - DNA, 26 bp, Artificial Sequence
  Description of Artificial Sequence: Synthetic oligonucleotide
cctctctataatttcggggtgatcac

SEQ ID NO: 245 - DNA, 23 bp, Artificial Sequence
  Description of Artificial Sequence: Synthetic oligonucleotide
gatcatggagagattacaggccg

SEQ ID NO: 246 - DNA, 22 bp, Artificial Sequence
  Description of Artificial Sequence: Synthetic oligonucleotide
cgttttcccctacaactttggc

SEQ ID NO: 247 - DNA, 52 bp, Artificial Sequence
  Description of Artificial Sequence: Synthetic oligonucleotide
aaagaaagaaagaaactataacaatcaatcatgagtcacccaacgccagaag

SEQ ID NO: 248 - DNA, 55 bp, Artificial Sequence
  Description of Artificial Sequence: Synthetic oligonucleotide
tcttatcaaaagagtcactctcttctattcttacgactcagctatgtacaacctc

SEQ ID NO: 249 - DNA, 37 bp, Artificial Sequence
  Description of Artificial Sequence: Synthetic oligonucleotide
cacacagctcttccataatggtcgccgattctttagt

SEQ ID NO: 250 - DNA, 47 bp, Artificial Sequence
  Description of Artificial Sequence: Synthetic oligonucleotide
cacacagctcttccctctcttctattcttaagtggccttccacaagt

SEQ ID NO: 251 - DNA, 50 bp, Artificial Sequence
  Description of Artificial Sequence: Synthetic oligonucleotide
ttgatagttgcgaatttaggtcgacaacgatataaacattagcatgcctg

SEQ ID NO: 252 - DNA, 47 bp, Artificial Sequence
  Description of Artificial Sequence: Synthetic oligonucleotide
cattatggtgttccggttatgaattcggttgaattgtggagtaaaaa

SEQ ID NO: 253 - DNA, 52 bp, Artificial Sequence
  Description of Artificial Sequence: Synthetic oligonucleotide
cccgaaatattacaattggagctcaaggctatctttaagtctattgacgaca

SEQ ID NO: 254 - DNA, 54 bp, Artificial Sequence
  Description of Artificial Sequence: Synthetic oligonucleotide
gtcagatttcacgcctttacgaattcatcagacttttcaaatctttctctttcg

SEQ ID NO: 255 - DNA, 50 bp, Artificial Sequence
  Description of Artificial Sequence: Synthetic oligonucleotide
caggcatgctaatgtttatatcgttgtcgacctaaattcgcaactatcaa

SEQ ID NO: 256 - DNA, 52 bp, Artificial Sequence
  Description of Artificial Sequence: Synthetic oligonucleotide
tgtcgtcaatagacttaaagatagccttgagctccaattgtaatatttcggg

SEQ ID NO: 257 - DNA, 20 bp, Artificial Sequence
  Description of Artificial Sequence: Synthetic oligonucleotide
cattatggtgttccggttat

SEQ ID NO: 258 - DNA, 20 bp, Artificial Sequence
  Description of Artificial Sequence: Synthetic oligonucleotide
gtcagatttcacgcctttac

SEQ ID NO: 259 - DNA, 30 bp, Artificial Sequence
  Description of Artificial Sequence: Synthetic oligonucleotide
cctacttccacagctttaatctactatcat

SEQ ID NO: 260 - DNA, 27 bp, Artificial Sequence
  Description of Artificial Sequence: Synthetic oligonucleotide
tttaagaaaacaactaagagaagccac

SEQ ID NO: 261 - DNA, 23 bp, Artificial Sequence
  Description of Artificial Sequence: Synthetic oligonucleotide
cattgaagagtgttttgccagaa

SEQ ID NO: 262 - DNA, 47 bp, Artificial Sequence
  Description of Artificial Sequence: Synthetic oligonucleotide
ccgaaacaaccgtagatacctttaaggcaaaaatgcaatcactctgt

SEQ ID NO: 263 - DNA, 47 bp, Artificial Sequence
  Description of Artificial Sequence: Synthetic oligonucleotide
acagagtgattgcatttttgccttaaaggtatctacggttgtttcgg

SEQ ID NO: 264 - DNA, 42 bp, Artificial Sequence
  Description of Artificial Sequence: Synthetic oligonucleotide
cgaaatattacaattggagctcggtaccgagctctgcgaatt

SEQ ID NO: 265 - DNA, 42 bp, Artificial Sequence
  Description of Artificial Sequence: Synthetic oligonucleotide
aattcgcagagctcggtaccgagctccaattgtaatatttcg

SEQ ID NO: 266 - DNA, 40 bp, Artificial Sequence
  Description of Artificial Sequence: Synthetic oligonucleotide
cagtggcggctttaaccttccgcatatggtcgacctaaat

SEQ ID NO: 267 - DNA, 40 bp, Artificial Sequence
  Description of Artificial Sequence: Synthetic oligonucleotide
atttaggtcgaccatatgcggaaggttaaagccgccactg

SEQ ID NO: 268 - DNA, 20 bp, Artificial Sequence
  Description of Artificial Sequence: Synthetic oligonucleotide
gggtccactcgtcatccaac

SEQ ID NO: 269 - DNA, 56 bp, Artificial Sequence
  Description of Artificial Sequence: Synthetic oligonucleotide
aaagaaagaaagaaactataacaatcaatcatgattgaacaactcctagaatattg

SEQ ID NO: 270 - DNA, 51 bp, Artificial Sequence
  Description of Artificial Sequence: Synthetic oligonucleotide
tcttatcaaaagagtcactctcttctattcctagtcaaacttgacaatagc

SEQ ID NO: 271 - DNA, 24 bp, Artificial Sequence
  Description of Artificial Sequence: Synthetic oligonucleotide
gaatagaagagagtgactcttttg

SEQ ID NO: 272 - DNA, 27 bp, Artificial Sequence
  Description of Artificial Sequence: Synthetic oligonucleotide
gattgattgttatagtttctttctttc

SEQ ID NO: 273 - DNA, 37 bp, Artificial Sequence
  Description of Artificial Sequence: Synthetic oligonucleotide
cacacagctcttccataatggtcaacatatcgaaatt

SEQ ID NO: 274 - DNA, 47 bp, Artificial Sequence
  Description of Artificial Sequence: Synthetic oligonucleotide
cacacagctcttccctctcttctattcttatatttcaaatactttat

SEQ ID NO: 275 - DNA, 38 bp, Artificial Sequence
  Description of Artificial Sequence: Synthetic oligonucleotide
cacacagctcttccataatgacagtggagaatgcaaaa

SEQ ID NO: 276 - DNA, 63 bp, Artificial Sequence
  Description of Artificial Sequence: Synthetic oligonucleotide
cacacagctcttccctctcttctattcctacttcttggcgacactcttcttttcattctcctt

SEQ ID NO: 277 - DNA, 23 bp, Artificial Sequence
  Description of Artificial Sequence: Synthetic oligonucleotide
gacgggttataacaagcaggaca

SEQ ID NO: 278 - DNA, 50 bp, Artificial Sequence
  Description of Artificial Sequence: Synthetic oligonucleotide
ccgaaacaaccgtagatacctttaatcaagatcttccagataatggtcaa

SEQ ID NO: 279 - DNA, 50 bp, Artificial Sequence
  Description of Artificial Sequence: Synthetic oligonucleotide
ttgaccattatctggaagatcttgattaaaggtatctacggttgtttcgg

SEQ ID NO: 280 - DNA, 45 bp, Artificial Sequence
  Description of Artificial Sequence: Synthetic oligonucleotide
caacaaataacaagttcttgcccttggtaccgagctctgcgaatt

SEQ ID NO: 281 - DNA, 45 bp, Artificial Sequence
  Description of Artificial Sequence: Synthetic oligonucleotide
aattcgcagagctcggtaccaagggcaagaacttgttatttgttg

SEQ ID NO: 282 - DNA, 25 bp, Artificial Sequence
  Description of Artificial Sequence: Synthetic oligonucleotide
cttactaagagatggacggtttgaa

SEQ ID NO: 283 - DNA, 24 bp, Artificial Sequence
  Description of Artificial Sequence: Synthetic oligonucleotide
aattgacgggttataacaagcagg

SEQ ID NO: 284 - DNA, 47 bp, Artificial Sequence
  Description of Artificial Sequence: Synthetic oligonucleotide
aattcgcagagctcggtaccggtgatgtactggtctatgttttggat

SEQ ID NO: 285 - DNA, 47 bp, Artificial Sequence
  Description of Artificial Sequence: Synthetic oligonucleotide
atccaaaacatagaccagtacatcaccggtaccgagctctgcgaatt

SEQ ID NO: 286 - DNA, 52 bp, Artificial Sequence
  Description of Artificial Sequence: Synthetic oligonucleotide
ggtcatcgtcatctatatcagcaatatttaaaggtatctacggttgtttcgg

SEQ ID NO: 287 - DNA, 52 bp, Artificial Sequence
  Description of Artificial Sequence: Synthetic oligonucleotide
ccgaaacaaccgtagatacctttaaatattgctgatatagatgacgatgacc

SEQ ID NO: 288 - DNA, 25 bp, Artificial Sequence
  Description of Artificial Sequence: Synthetic oligonucleotide
cacctggtacatcaactcttccata

SEQ ID NO: 289 - DNA, 23 bp, Artificial Sequence
  Description of Artificial Sequence: Synthetic oligonucleotide
cacacagctcttccataatgtcc

SEQ ID NO: 290 - DNA, 23 bp, Artificial Sequence
  Description of Artificial Sequence: Synthetic oligonucleotide
cacacagctcttccctctcttct

SEQ ID NO: 291 - DNA, 24 bp, Artificial Sequence
  Description of Artificial Sequence: Synthetic oligonucleotide
cacacagctcttccataatgtcag

SEQ ID NO: 292 - DNA, 37 bp, Artificial Sequence
  Description of Artificial Sequence: Synthetic oligonucleotide
cacacagctcttccatcatgtccgccaacgaaaacat

SEQ ID NO: 293 - DNA, 40 bp, Artificial Sequence
  Description of Artificial Sequence: Synthetic oligonucleotide
cacacagctcttccagctcatgatctagtcttggccttag

SEQ ID NO: 294 - DNA, 55 bp, Artificial Sequence
  Description of Artificial Sequence: Synthetic oligonucleotide
cacacagctcttccatcatgtcagcgaaatctattcacgaagccgacggtaaggc

SEQ ID NO: 295 - DNA, 44 bp, Artificial Sequence
  Description of Artificial Sequence: Synthetic oligonucleotide
cacacagctcttccagctcacacgcctaaaggagtagaagcttc

SEQ ID NO: 296 - DNA, 43 bp, Artificial Sequence
  Description of Artificial Sequence: Synthetic oligonucleotide
cacacagctcttccataatgcctaccgaacttcaaaaagaaag

SEQ ID NO: 297 - DNA, 51 bp, Artificial Sequence
  Description of Artificial Sequence: Synthetic oligonucleotide
cacacagctcttccctctcttctattcttaactggacaagatttcagcagc

SEQ ID NO: 298 - DNA, 39 bp, Artificial Sequence
  Description of Artificial Sequence: Synthetic oligonucleotide
gtctttgacccacaagtcggaaccagaatcggtgtcaac

SEQ ID NO: 299 - DNA, 39 bp, Artificial Sequence
  Description of Artificial Sequence: Synthetic oligonucleotide
gttgacaccgattctggttccgacttgtgggtcaaagac

SEQ ID NO: 300 - DNA, 37 bp, Artificial Sequence
  Description of Artificial Sequence: Synthetic oligonucleotide
gtaaagcctactccgactttgttgtccaatgtacctg

SEQ ID NO: 301 - DNA, 37 bp, Artificial Sequence
  Description of Artificial Sequence: Synthetic oligonucleotide
caggtacattggacaacaaagtcggagtaggctttac

SEQ ID NO: 302 - DNA, 53 bp, Artificial Sequence
  Description of Artificial Sequence: Synthetic oligonucleotide
gaattcacatggctaatttggcctcggttccacaacgcactcagcattaaaaa

SEQ ID NO: 303 - DNA, 40 bp, Artificial Sequence
  Description of Artificial Sequence: Synthetic oligonucleotide
gagctcccctgcaaacagggaaacacttgtcatctgattt

SEQ ID NO: 304 - DNA, 25 bp, Artificial Sequence
  Description of Artificial Sequence: Synthetic oligonucleotide
gatattattccaccttcccttcatt

SEQ ID NO: 305 - DNA, 26 bp, Artificial Sequence
  Description of Artificial Sequence: Synthetic oligonucleotide
ccgttaaacaaaaatcagtctgtaaa

SEQ ID NO: 306 - DNA, 24 bp, Artificial Sequence
  Description of Artificial Sequence: Synthetic oligonucleotide
tgccatccttggtagtcagttatt

SEQ ID NO: 307 - DNA, 45 bp, Artificial Sequence
  Description of Artificial Sequence: Synthetic oligonucleotide
ccgaaacaaccgtagatacctttaatggcttgtccttggtgttga

SEQ ID NO: 308 - DNA, 22 bp, Artificial Sequence
  Description of Artificial Sequence: Synthetic oligonucleotide
tgtcgccattcaaccagtagat

SEQ ID NO: 309 - DNA, 43 bp, Artificial Sequence
  Description of Artificial Sequence: Synthetic oligonucleotide
aattcgcagagctcggtaccgacttgttgaagatggacgagga

SEQ ID NO: 310 - DNA, 45 bp, Artificial Sequence
  Description of Artificial Sequence: Synthetic oligonucleotide
tcaacaccaaggacaagccattaaaggtatctacggttgtttcgg

SEQ ID NO: 311 - DNA, 43 bp, Artificial Sequence
  Description of Artificial Sequence: Synthetic oligonucleotide
tcctcgtccatcttcaacaagtcggtaccgagctctgcgaatt

SEQ ID NO: 312 - DNA, 26 bp, Artificial Sequence
  Description of Artificial Sequence: Synthetic oligonucleotide
ttgatccactgtcttaagattgtcaa

SEQ ID NO: 313 - DNA, 20 bp, Artificial Sequence
  Description of Artificial Sequence: Synthetic oligonucleotide
aggattttgctgttggtggc

SEQ ID NO: 314 - DNA, 41 bp, Artificial Sequence
  Description of Artificial Sequence: Synthetic oligonucleotide
aattcgcagagctcggtaccatacgtcggtgaggtctgtcg

SEQ ID NO: 315 - DNA, 47 bp, Artificial Sequence
  Description of Artificial Sequence: Synthetic oligonucleotide
attctccgctacttcgttctggttaaaggtatctacggttgtttcgg

SEQ ID NO: 316 - DNA, 41 bp, Artificial Sequence
  Description of Artificial Sequence: Synthetic oligonucleotide
cgacagacctcaccgacgtatggtaccgagctctgcgaatt

SEQ ID NO: 317 - DNA, 47 bp, Artificial Sequence
  Description of Artificial Sequence: Synthetic oligonucleotide
ccgaaacaaccgtagatacctttaaccagaacgaagtagcggagaat

SEQ ID NO: 318 - DNA, 40 bp, Artificial Sequence
  Description of Artificial Sequence: Synthetic oligonucleotide
aagcttttaattaaagataatcacaggggtagagaccttg

SEQ ID NO: 319 - DNA, 48 bp, Artificial Sequence
  Description of Artificial Sequence: Synthetic oligonucleotide
ggatccgcatgcggccggccgatagcgtggtatgaatgaataagtgtg

SEQ ID NO: 320 - DNA, 51 bp, Artificial Sequence
  Description of Artificial Sequence: Synthetic oligonucleotide
ggatccgagctcgcggccgcgagcactaggttttgataatttggttcttac

SEQ ID NO: 321 - DNA, 36 bp, Artificial Sequence
  Description of Artificial Sequence: Synthetic oligonucleotide
gaattcttaattaacggcgaagaacatagtgtgatg

SEQ ID NO: 322 - protein, 355 aa, Sulfolobus islandicus
MRRTLKAAILGSTGLVGIEYVRMLANHPYIKVGYLAGKGSVGKPYEEVVRWQTVGQVPKEIADMEVKPTDPKLMDDVDIIFSPLPQGAAGPVEEEFAKHGFPVISNSPDHRFDPDVPLLIPEINPHTISLIDKQRERHDWRGFIVTTPLCTAQGAAIPLAPIYMNFRIDSSLITTIQSLSGAGYPGIPSLDVVDNVLPLGDNYDNKTVKEISRILSETKRMVNDDNDLSLGATTHRISTIHGHYEVIYVTFREDVSVEKIRETLDSFRGEPQKLKLPTAPDKPILLTNQDARPQVYFDRWAGDPPGMSVVVGRLSQINRRTIRLVSVVHNTVRGAAGGGILAAELLVEKGYIDKR

SEQ ID NO: 323 - DNA, 1068 bp, Sulfolobus islandicus
atgaggagaactcttaaggccgccattttgggatcgactggattggttggtatcgaatatgttagaatgttagcaaaccacccttacataaaggtgggttacctagcgggtaagggctcagtcggcaagccctacgaagaagttgtcagatggcaaaccgtcggccaagttcctaaagaaatcgctgatatggaagtcaagcctaccgatcccaagttgatggacgacgtcgacattatcttttcgccgttgccccaaggcgctgctggtcctgttgaagaggaatttgccaaacatggatttcctgtcatttccaactctcctgatcacagattcgacccagatgtccctctcctcatcccagaaatcaatccgcatacaatctcgcttattgacaaacaaagggaaaggcatgactggaggggcttcatcgttaccactcctttgtgcaccgcgcaaggtgctgccattcctttggcccctatctatatgaatttcagaatcgactccagtctcatcactaccattcaatcgctctctggcgctgggtatccaggtatcccatcattagacgttgtcgacaacgtcttgccattaggcgataattatgacaacaaaacagttaaagagatttccaggattttgtccgagacaaagaggatggtgaacgatgacaacgatctatcgttgggcgccactacccacagaatctcgactattcacgggcattacgaggtcatttatgtaaccttcagagaagacgtttccgtcgaaaagataagagagacgttagactcatttagaggtgaaccccagaagttgaagttgcctaccgcgcctgacaagcctatacttttgaccaaccaagacgcaagaccacaagtctactttgacaggtgggccggagaccctccaggtatgtccgtggtcgtgggtagattgagtcaaatcaacaggagaaccattaggctcgtctcggtcgttcataataccgtcaggggagctgctggtggtggaatcttggccgctgaactactcgtagagaagggttacattgacaagaggtaa

SEQ ID NO: 324 - protein, 402 aa, Gerbera hybrida
MGSYSSDDVEVIREAGRAQGLATILAIGTATPPNCVAQADYADYYFRVTKSEHMVDLKEKFKRICEKTAIKKRYLALTEDYLQENPTMCEFMAPSLNARQDLVVTGVPMLGKEAAVKAIDEWGLPKSKITHLIFCTTAGVDMPGADYQLVKLLGLSPSVKRYMLYQQGCAAGGTVLRLAKDLAENNKGSRVLIVCSEITAILFHGPNENHLDSLVAQALFGDGAAALIVGSGPHLAVERPIFEIVSTDQTILPDTEKAMKLHLREGGLTFQLHRDVPLMVAKNIENAAEKALSPLGITDWNSVFWMVHPGGRAILDQVERKLNLKEDKLRASRHVLSEYGNLISACVLFIIDEVRKRSMAEGKSTTGEGLDCGVLFGFGPGMTVETVVLRSVRVTAAVANGN

SEQ ID NO: 325 - DNA, 1209 bp, Gerbera hybrida
atgggatcctactcaagtgacgacgtcgaagtcattcgtgaagccggacgagcgcaaggtctcgccaccattttagccattggcactgctactcctccgaattgtgttgctcaagctgactatgcggattattatttccgtgttactaagtctgagcatatggtggacttaaaagaaaaattcaaacggatttgcgaaaaaacggcaataaagaaacggtacctagccttgacagaggattatctccaagaaaacccaacgatgtgcgaatttatggctccaagtctcaacgctcggcaagatctagtcgttacaggcgttccaatgttaggcaaagaggccgcggttaaggccattgacgagtggggactaccaaaaagtaagatcacacacttgatcttttgtacaacagctggcgtggatatgccgggtgctgattatcaattggttaaattgttaggtttgagtccttcagttaaacggtatatgctttaccaacagggatgcgccgccggcggcacggttttgcgactagccaaggatttagctgagaacaacaagggctcacgggttttaatcgtttgtagtgaaatcactgctatcctctttcatggaccgaatgaaaaccacttagattcattggttgctcaagctctctttggagatggagctgcggcgttgattgtcggttcaggccctcaccttgccgtagagcgaccaatatttgaaatcgtctcaactgaccaaacgatccttcccgatactgaaaaggcgatgaagctccaccttagagaaggagggcttaccttccagcttcatagagacgtaccgcttatggttgcgaagaacatagaaaacgcggcagaaaaagcactttccccactagggataactgactggaactcagtgttttggatggtccacccaggtggtcgggccatacttgatcaggtcgaacggaaactaaacttaaaggaggacaagctcagggcttctaggcatgtcttaagcgagtacggaaacctcatttctgcttgcgtcctttttatcattgatgaagtcaggaagagatccatggcagaggggaagagcacgacaggtgagggtcttgactgtggtgtgcttttcggattcggacccggtatgactgtggaaactgtggtgttacgttctgttcgggtgactgctgcagtggccaatggaaactaa

SEQ ID NO: 326 - protein, 301 aa, Chronobacter sakazakii
MNANAVKSSGQEIELQALRDALQTRLDELLPPGQERDLVCAAMREGALTPGKRVRPLLLILAARDLGCDASQPALMDLACAVEMVHAASLMLDDIPCMDNALLRRGKPTIHRQYGESVAILAAVALLSRAFGVVAQANPLSDSCKTQAVSELSSAVGLQGLVQGQFRDLSEGNQARSAEAILATNDLKTSVLFDATLQIAAIAAGASASVRHKLREFSRHLGQAFQLLDDLADGLNHTGKDINKDAGKSTLVAMLGPEAVHQRLRDHLLRADEHLTGACSRGASTRRFMYAWFDKQLAMFG

SEQ ID NO: 327 - protein, 492 aa, Chronobacter sakazakii
MTKTVVIGSGFGGLALAIRLQAAGVPTLLLEQRDKPGGRAYVYEDKGFTFDAGPTVITDPSAIEELFTLAGKNIADYVDLLPVTPFYRLCWENGQVFNYDNDQASLEAQIARFNPRDVEGYRQFLAYSQAVFKEGYLKLGAVPFLSFRDMLRAGPQLARLQAWRSVYGMVSKFIENDHLRQAFSFHSLLVGGNPFATSSIYTLIHALERQWGVWFARGGTGALVQGLVKLFTDLGGEIELNAKVTRLDTQGDKISGVTLADGRRIPARAVASNADVVHTYNNLLGHHPRGVSQAASLRRKRMSNSLFVLYFGLNHHHSQLAHHTVCFGPRYKGLIEDIFKRDSLADDFSLYLHAPCVTDPSLAPPGCGSYYVLAPVPHLGTANLNWDVEGPRLRDRIFEYLEQHYMPGLRDQLVTHRMFTPFDFRDQLGAYHGSAFSVEPILTQSAWFRPHNRDSRIDNLYLVGAGTHPGAGIPGVIGSAKATAGLMLEGHA

SEQ ID NO: 328 - protein, 323 aa, Chronobacter sakazakii
MSDKPLLTHATETIEAGSKSFATASKLFDAKTRRSALMLYAWCRHCDDVTDGQALGFRAADAPTDTPQARIALLRALTLEAYAGKPMREPNFAAFQEVALAHQIPPALALDHLEGFAMDVREERYHTFDDTLRYCYHVAGVVGLMMARVMGVRDEAVLDRACDLGLAFQLTNIARDIVEDAAIGRCYLPEAWLQEEGLCADTLTDRAHRPALARLAARLVDEAEPYYASARAGLAGLPLRSAWAIATAHGVYREIGVKVKRAGVNAWETRQGTSKAEKLALLAKGAVMAVSSRGASSSPRPSALWQRPRAQDDRYAHAAPPAA

SEQ ID NO: 329 - protein, 376 aa, Xanthophyllomyces dendrorhous
MDYANILTAIPLEFTPQDDIVLLEPYHYLGKNPGKEIRSQLIEAFNYWLDVKKEDLEVIQNVVGMLHTASLLMDDVEDSSVLRRGSPVAHLIYGIPQTINTANYVYFLAYQEIFKLRPTPIPMPVIPPSSASLQSSVSSASSSSSASSENGGTSTPNSQIPFSKDTYLDKVITDEMLSLHRGQGLELFWRDSLTCPSEEEYVKMVLGKTGGLFRIAVRLMMAKSECDIDFVQLVNLISIYFQIRDDYMNLQSSEYAHNKNFAEDLTEGKFSFPTIHSIHANPSSRLVINTLQKKSTSPEILHHCVNYMRTETHSFEYTQEVLNTLSGALERELGRLQGEFAEANSKIDLGDVESEGRTGKNVKLEAILKKLADIPL

SEQ ID NO: 330 - protein, 582 aa, Xanthophyllomyces dendrorhous
MGKEQDQDKPTAIIVGCGIGGIATAARLAKEGFQVTVFEKNDYSGGRCSLIERDGYRFDQGPSLLLLPDLFKQTFEDLGEKMEDWVDLIKCEPNYVCHFHDEETFTFSTDMALLKREVERFEGKDGFDRFLSFIQEAHRHYELAVVHVLQKNFPGFAAFLRLQFIGQILALHPFESIWTRVCRYFKTDRLRRVFSFAVMYMGQSPYSAPGTYSLLQYTELTEGIWYPRGGFWQVPNTLLQIVKRNNPSAKFNFNAPVSQVLLSPAKDRATGVRLESGEEHHADVVIVNADLVYASEHLIPDDARNKIGQLGEVKRSWWADLVGGKKLKGSCSSLSFYWSMDRIVDGLGGHNIFLAEDFKGSFDTIFEELGLPADPSFYVNVPSRIDPSAAPEGKDAIVILVPCGHIDASNPQDYNKLVARARKFVIQTLSAKLGLPDFEKMIVAEKVHDAPSWEKEFNLKDGSILGLAHNFMQVLGFRPSTRHPKYDKLFFVGASTHPGTGVPIVLAGAKLTANQVLESFDRSPAPDPNMSLSVPYGKPLKSNGTGIDSQVQLKFMDLERWVYLLVLLIGAVIARSVGVLAF

SEQ ID NO: 331 - protein, 673 aa, Xanthophyllomyces dendrorhous
MTALAYYQIHLIYTLPILGLLGLLTSPILTKFDIYKISILVFIAFSATTPWDSWIIRNGAWTYPSAESGQGVFGTFLDVPYEEYAFFVIQTVITGLVYVLATRHLLPSLALPKTRSSALSLALKALIPLPIIYLFTAHPSPSPDPLVTDHYFYMRALSLLITPPTMLLAALSGEYAFDWKSGRAKSTIAAIMIPTVYLIWVDYVAVGQDSWSINDEKIVGWRLGGVLPIEEAMFFLLTNLMIVLGLSACDHTQALYLLHGRTIYGNKKMPSSFPLITPPVLSLFFSSRPYSSQPKRDLELAVKLLEEKSRSFFVASAGFPSEVRERLVGLYAFCRVTDDLIDSPEVSSNPHATIDMVSDFLTLLFGPPLHPSQPDKILSSPLLPPSHPSRPTGMYPLPPPPSLSPAELVQFLTERVPVQYHFAFRLLAKLQGLIPRYPLDELLRGYTTDLIFPLSTEAVQARKTPIETTADLLDYGLCVAGSVAELLVYVSWASAPSQVPATIEEREAVLVASREMGTALQLVNIARDIKGDATEGRFYLPLSFFGLRDESKLAIPTDWTEPRPQDFDKLLSLSPSSTLPSSNASESFRFEWKTYSLPLVAYAEDLAKHSYKGIDRLPTEVQAGMRAACASYLLIGREIKVVWKGDVGERRTVAGWRRVRKVLSVVMSGWEGQ

SEQ ID NO: 332 - protein, 302 aa, Pantoea ananatis
MTVCAKKHVHLTRDAAEQLLADIDRRLDQLLPVEGERDVVGAAMREGALAPGKRIRPMLLLLTARDLGCAVSHDGLLDLACAVEMVHAASLILDDMPCMDDAKLRRGRPTIHSHYGEHVAILAAVALLSKAFGVIADADGLTPLAKNRAVSELSNAIGMQGLVQGQFKDLSEGDKPRSAEAILMTNHFKTSTLFCASMQMASIVANASSEARDCLHRFSLDLGQAFQLLDDLTDGMTDTGKDSNQDAGKSTLVNLLGPRAVEERLRQHLQLASEHLSAACQHGHATQHFIQAWFDKKLAAVS

SEQ ID NO: 333 - protein, 492 aa, Pantoea ananatis
MKPTTVIGAGFGGLALAIRLQAAGIPVLLLEQRDKPGGRAYVYEDQGFTFDAGPTVITDPSAIEELFALAGKQLKEYVELLPVTPFYRLCWESGKVFNYDNDQTRLEAQIQQFNPRDVEGYRQFLDYSRAVFKEGYLKLGTVPFLSFRDMLRAAPQLAKLQAWRSVYSKVASYIEDEHLRQAFSFHSLLVGGNPFATSSIYTLIHALEREWGVWFPRGGTGALVQGMIKLFQDLGGEVVLNARVSHMETTGNKIEAVHLEDGRRFLTQAVASNADVVHTYRDLLSQHPAAVKQSNKLQTKRMSNSLFVLYFGLNHHHDQLAHHTVCFGPRYRELIDEIFNHDGLAEDFSLYLHAPCVTDSSLAPEGCGSYYVLAPVPHLGTANLDWTVEGPKLRDRIFAYLEQHYMPGLRSQLVTHRMFTPFDFRDQLNAYHGSAFSVEPVLTQSAWFRPHNRDKTITNLYLVGAGTHPGAGIPGVIGSAKATAGLMLEDLI

SEQ ID NO: 334 - protein, 309 aa, Pantoea ananatis
MNNPSLLNHAVETMAVGSKSFATASKLFDAKTRRSVLMLYAWCRHCDDVIDDQTLGFQARQPALQTPEQRLMQLEMKTRQAYAGSQMHEPAFAAFQEVAMAHDIAPAYAFDHLEGFAMDVREAQYSQLDDTLRYCYHVAGVVGLMMAQIMGVRDNATLDRACDLGLAFQLTNIARDIVDDAHAGRCYLPASWLEHEGLNKENYAAPENRQALSRIARRLVQEAEPYYLSATAGLAGLPLRSAWAIATAKQVYRKIGVKVEQAGQQAWDQRQSTTTPEKLTLLLAASGQALTSRMRAHPPRPAHLWQRPL

SEQ ID NO: 335 - protein, 746 aa, Xanthophyllomyces dendrorhous
MATLSDLVILLLGALLALGFYNKDRLLGSSSSSASTTSGSSAATANGSKPTYSNGNGNAFKGDPRDFVARMKDQKKRLAVFYGSQTGTAEEYATRIAKEAKSRFGVSSLVCDIEEYDFEKLDQVPEDCAIVFCMATYGEGEPTDNAVQFIEMISQDDPEFSEGSTLDGLKYVVFGLGNKTYEQYNVVGRQLDARLTALGATRVGERGEGDDDKSMEEDYLAWKDDMFAALATTLSFEEGASGETPDFVVTEVPNHPIEKVFQGELSSRALLGSKGVHDAKNPYASPVLACRELFTGGDRNCIHLEFDITGSGITYQTGDHVAVWPSNPDVEVERLLAVLGLTSPEKRRMIIQVVSLDPTLAKVPFPTPTTYDAVFRHYLDISAVASRQTLAVLAKYAPSEQAAEFLTRLGTDKQAYHTEVVGGHLRLAEVLQLAAGNDITVMPTAENTTVWNIPFDHVVSDVSRLQPRFYSISSSPKLHPNSIHVTAVILKYESQATDRHPARWVFGLGTNYLLNVKQAANNETTPMISDGQDDVPEHVSAPKYTLEGPRGSYKHDDQLFKVPIHVRRSTFRLPTSPKIPVIMIGPGTGVAPFRGFIQERIALARRSIAKNGPDALADWAPIYLFYGSRDEQDFLYAEEWPAYEAELQGKFKIHVAFSRSGPRKPDGSKIYVQDLLWDQKEVIKSAIVEKRASVYICGDGRNMSKDVEQKLAAMLAESKNGSAAVEGAAEVKSLKERSRLLMDVWS

SEQ ID NO: 336 - protein, 557 aa, Xanthophyllomyces dendrorhous
MFILVLLTGALGLAAFSWASIAFFSLYLAPRRSSLYNLQGPNHTNYFTGNFLDILSARTGEEHAKYREKYGSTLRFAGIAGAPVLNSTDPKVFNHVMKEAYDYPKPGMAARVLRIATGDGVVTAEGEAHKRHRRIMIPSLSAQAVKSMVPIFLEKGMELVDKMMEDAAEKDMAVGESAGEKKATRLETEGVDVKDWVGRATLDVMALAGFDYKSDSLQNKTNELYVAFVGLTDGFAPTLDSFKAIMWDFVPYFRTMKRRHEIPLTQGLAVSRRVGIELMEQKKQAVLGSASDQAVDKKDVQGRDILSLLVRANIAANLPESQKLSDEEVLAQISNLLFAGYETSSTVLTWMFHRLSEDKAVQDKLREEICQIDTDMPTLDELNALPYLEAFVKESLRLDPPSPYANRECLKDEDFIPLAEPVIGRDGSVINEVRITKGTMVMLPLFNINRSKFIYGEDAEEFRPERWLEDVTDSLNSIEAPYGHQASFISGPRACFGWRFAVAEMKAFLFVTLRRVQFEPIISHPEYEHITLIISRPRIVGREKEGYQMRLQVKPVE

SEQ ID NO: 337 - protein, 403 aa, Candida viswanathii
MTLPPVYIVSTARTPIGSFQGSLSSLTYSDLGAHAVKAALAKVPQIKPQDVDEIVFGGVLQANVGQAPARQVALKAGLPDSIIASTINKVCASGMKAVIIGAQNIICGTSDIVVVGGAESMSNTPYYLPSARSGARYGDAVMVDGVQKDGLLDVYEEKLMGVAAEKCAKDHGFSREDQDNFAINSYKKAGKALSEGKFKSEIAPVTIKGFRGKPDTVIENDEEIGKFNEDRLKSARTVFQKENGTVTAPNASKLNDGGAALVLVSEAKLKQLGLKPLAKISGWGEAARTPFDFTIAPALAVPKAVKHAGLTVDRVDFFELNEAFSVVGLANAELVKIPLEKLNVYGGAVAMGHPLGCSGARIIVTLLSVLTQEGGRFGAAGVCNGGGGASAIVIEKIDSDAKL

SEQ ID NO: 338 - protein, 449 aa, Candida viswanathii
MTNAPQNIGIKGIEVYIPGQAVNQSDLEKFDGIPAGKYTIGLGQTNMAFVNDREDIYSIALTVVSRLIKHYNVDTNNVGRLEVGTETLLDKSKSVKSVLMQLFPDNNDIEGIDTVNACYGGTSAVINAINWIESSSWDGRDAIVVAGDIAIYDKGAARPTGGAGSIAMLIGPDAPIVFDSVRGSFMEHAYDFYKPDFTSEYPVVDGHFSLSCYVKAVDNCYKNYSKKVTGNVDKTVGVYDHFDYNAFHVPTCKLVTKSYARLLYNDYKSDPSKFADLIDESTRQHIDSLSYEASLTDKVLEKTFVTLAKEETKKRVQPALQVPTNTGNMYTASSWVSLASLLYYVGAENLKEKRIGLFSYGSGLASTLLSVTVVGDVSPITKVLDFDYKLGEGRKIQSPEEYLAAIELREKAHLQKSFKPQGSLDNLSQGTYYLTEVDDKFRRSYAIKE

SEQ ID NO: 339 - protein, 1039 aa, Candida viswanathii
MLSFITEASGRIAQTAAHRPIHFMVIPALLASIAYLSIIDDYVPEHIRAQYMSGVSYFHPQGSASDLDKWIEIHDTTQYANANQISVIPLRFRRFHDSIPQIANAIKISNNEQILIVPSDKAESTVEGLSEITENGITWRARNNDKLSKYYDYARYGLLRIQDAIHNADNFDILLVFVAYLGMWYSLIKVFIDMRRIGSKFWLAFGTLTSSTFSFLFALVISNKFLDAKVSLRSLSECIPFLVAIIGFKHKVAITTSVAQSSTSSPEDVPHVVGKAVSDQCLFILRDHLVVIIGFLACAAYGNELKGLRNFCILGALILSFDIVSVYTFFSAILALKVEINRARRTQDLQHVLEEDGISSLVAARVAERNATIEHPNETNFFSSNNSSIVYFKVIMSLGFFAFHAFWLGSSWLYNTSDGGSHGSFSFLSNIPLLTQDISNSIPIGRRGTVVTILPTTFYMPSGIIIQFEDMVYLALSKISSAIRDSLISKCIVFALTISIVTNIYFLNAARFQVSATRKLIDQEMSRPKQAAAAAAAAPSAAKSVAPEEDEDETSSEELEIKAPVKPLSLEECTRILKEGKVKTLSNAEVSSLVVGGKLPLYALEKQLGDNKRAVAVRRKAIAKLANAPVLETNRLPYSHYDYDRVFGACCENVIGYMPIPVGVAGPLVIDGKPYHIPMATTEGCLVASTMRGCKAINAGGGVETVLTKDGMTRGPCVRFPTLKRAGAAKLWIDSEEGQITIKKAFNSTSRFARLQHIQTALAGTSLFIRFRTTTGDAMGMNMISKGVEYSLKHMVEECGWDDMEVISVSGNYCTDKKPAAINWIEGRGKSIVAAATIPADVVTKVLKSDVDALVELNVSKNLVGSAMAGSVGGFNAHAANLVTAVYLACGQDPAQNVESSNCITLMEKDKQTGDLVISVSMPSIEVGTIGGGTILEPQAAMLDLLGVRGPHPTNPGDNARQLAKIVASAVLAAELSLCSALAAGHLVQSHMQHNRKGATPAAAPAISNGSAKGTKTNGSINGKDLKRLKDGSVTCIKS

SEQ ID NO: 340 - protein, 432 aa, Candida viswanathii
MSVSPFVVSAPGKVIIFGEHSAVYGKPAIAAALSLRCYLLVSPSVDDANTIRLQFPDIQLDHSWDINDIPWDEIKPFVKYDANNKPLTSSELVPEIVDKLSPLLTDFDNKMHYYACFCFLYLYVNLCTAETPGTTFIVRSTLPIGAGLGSSASTSVCLSSALALLGGWISEPSISATDKILNEDIPDLEFVDKWSLIGEKCFHGNPSGIDNAVATFGGAVMFQRTSAPEQPSIRTNMRNFPAIKLLLTNTKVPKSTADLVAGVGKLNAEFNPITTSILTAMEHLSQEAYKVMITPGFGKDETNTLRKLVNINHGLLVALGVSHPSLETVKIIGDRHKIGATKLTGAGGGGCAITLVNDNVEESAIQEAIKEFAGEGYESFETSLGGKGVGVLFSGDVSVDGKFSQSVFCNYPDRASIEDALGMINVKEWKFW

SEQ ID NO: 341 - protein, 420 aa, Candida viswanathii
MSKAFSAPGKALLAGGYLVLEPTYDAYVTALSSRMHAIITPQKPASISKIKISSPQFANGEWEYHVTSNEKPKDIKSRSNPFLEATIFIVLSYIQPTEPFDLDLVIYSDPGYHSQEHTTQKVSSNGKKKFLYHSRAINDVEKTGLGSSAGLVSVVTTSLLSYFIPGIEESNKDMLHNVAQIAHCFAQKKIGSGFDVATAIYGSIVYRRFQPSLINDVFEILEETPGRFPGALKSLVESNWEFKHERCVLPPKIKLLMGDIKGGSETPKLVSKILQWKKDKPEESGLVYDQLNSANVAFMKKISTLNESSQVQEIDELSDYISAVRKGLQELTEKSKVPVEPPVQTELLDRIAKLPGCLGGVVPGAGGYDAIAVLVLEKEVENFRNKTLENPEYYHNVYWVDLEEETEGVVVENWEDYIGL

SEQ ID NO: 342 - protein, 369 aa, Candida viswanathii
MYSASVTAPVNIATLKYWGKRDKTLNLPTNSSISVTLSQDDLRTLTTAAASTTFDKDQLWLNGKLESLDTPRTQACLVDLRKLRADVEQANADLPKLSTMKLHIVSENNFPTAAGLASSAAGFAALITAIAKLYELPQDMSELSKIARKGSGSACRSLFGGFVAWEMGDAADGQDSKAVEVAPLDHWPSMRAVILVVSDDKKDTPSTTGMQATVQTSDLFAHRVTKVVPQCFEEMKKAIVAKDFPKFTELTMKDSNSFHAVCLDSYPPIFYLNDTSKKIIKLVEAINKHATIAAYTFDAGPNAVIYYDAANEDEVLSQLYKSFGHVQGWKKAYTAETAVAGVSRIIQTSIGQGPQVTNESLINESGLPN

SEQ ID NO: 343 - protein, 286 aa, Candida viswanathii
MSSEYAKLVASFSPNDILAKWPEVTPLKKISGIPRSAESDSSNGSHNNTELFNGHDEEQIRLMEELCIVLDYDDKPVGAGTKKLCHIMDNINEGLLHRAFSVFLFNEDGKLLLQQRADEKITFPAMWTNTCCSHPLCVPSELGVDADAKDVNNLDNAVHGAKVAAQRKLDHELGIPFSDTPLDQFTYLTRIHYKSASGAEDSKWGEHEIDYILILKTKNDITINANYNEVKDYKYVDAKELQEMFEDKDLVFTPWFKLICQSFLFKWWNNLSDLEKYQDTEIHRLL

SEQ ID NO: 344 - protein, 351 aa, Candida viswanathii
MSDKAAARERFLSVFECAVEELKEVLVSHKMPQEAIDWFVKNLNYNTPGGKLNRGLSVVDTYAILNNTTADKLNDEQYKKVALLGWSIELLQAYFLVADDMMDQSKTRRGQKCWYLVEGVGNIAINDSFMLEGAIYVLLKKHFRQDPYYVDLLDLFHEVTFQTELGQLLDLVTADEEVVDLDKFSLDKHSFIVIFKTAYYSFYLPVALAMYMSGISSEEDLKQVRDILIPLGEYFQIQDDFLDCFGTPEQIGKIGTDIKDNKCSWVVNQALLHATPEQRKLLDDNYGKKDDESEQRCKDLFKSMGIEKIYHDYEESIVAKLREQIDKVDESRGLKKDVLTAFLGKVYKRSK

SEQ ID NO: 345 - protein, 332 aa, Candida viswanathii
MSFNIDSLIQPGAAYDPSMTDAIMKPYRYISEVPSNNHNVRTRFLLAFNELFYGMKNEDLLHRISHIISVFHNSSLLIDDIEDDSQLRRGMPVAHVKYGVPLTINCGNMMYFVAVQKAIDLAGEAGSAELKFETSQILVDEMMNVHHGQGLDIYWRDYLKDLEHLPEIEDYLGMVKDKTGSLFRLAIKLLSLHSDVGEDNGLVAIANLLGIIYQIRDDYLNLVDIKYSAMKGVTCEDLIEGKLSLPILHCLRTTTNSPVHEILYNYNTSAERAKQNALIEECLTYMKNKSRSLQYTLDLIKTLERKIKAMMTKYPNSENSGLIKIIDRLCDL

SEQ ID NO: 346 - protein, 284 aa, Candida viswanathii; identical to SEQ ID NO: 14

SEQ ID NO: 347 - protein, 696 aa, Candida viswanathii; identical to SEQ ID NO: 35

SEQ ID NO: 348 - protein, 650 aa, Candida viswanathii; identical to SEQ ID NO: 44

SEQ ID NO: 349 - protein, 374 aa, Candida viswanathii
MSVKTKTITILPGDHVGTEIVAEAIKSLHAIESSTPYQKVHFEFKHHLIGGAAIDATGVPLPDDALAAAKSSDAVLLGAVGGPKWGTGAVRPEQGLLKIRKELNLYANIRPCNFASDSLLELSPLRPEVVKGTNLIIVRELVGGIYFGERQEQEESEDGKSAWDTEKYTVDEVARITRMAAFMALQHTPPLPIWSLDKANVLASSRLWRKTVDKIISEEFPTLAVQHQLIDSAAMILIQNPTKLNGIIITSNMFGDIISDEASVIPGSLGLLPSASLASLPDTNTAFGLYEPCHGSAPDLPENKVNPIATILSVASMLRLSLDCVKEAEALEQAVKEVLDKGIRTADLRGSSTTTEVGDAVAETVSRILKEAKA

SEQ ID NO: 350 - protein, 162 aa, Agrobacterium aurantiacum
MTNFLIVVATVLVMELTAYSVHRWIMHGPLGWGWHKSHHEEHDHALEKNDLYGLVFAVIATVLFTVGWIWAPVLWWIALGMTVYGLIYFVLHDGLVHQRWPFRYIPRKGYARRLYQAHRLHHAVEGRDHCVSFGFIYAPPVDKLKQDLKMSGVLRAEAQERT

SEQ ID NO: 351 - protein, 242 aa, Agrobacterium aurantiacum
MSAHALPKADLTATSLIVSGGIIAAWLALHVHALWFLDAAAHPILAIANFLGLTWLSVGLFIIAHDAMHGSVVPGRPRANAAMGQLVLWLYAGFSWRKMIVKHMAHHRHAGTDDDPDFDHGGPVRWYARFIGTYFGWREGLLLPVIVTVYALILGDRWMYVVFWPLPSILASIQLFVFGTWLPHRPGHDAFPDRHNARSSRISDPVSLLTCFHFGGYHHEHHLHPTVPWWRLPSTRTKGDTA

SEQ ID NO: 352 - protein, 589 aa, Callitropsis nootkatensis
MAEMFNGNSSNDGSSCMPVKDALRRTGNHHPNLWTDDFIQSLNSPYSDSSYHKHREILIDEIRDMFSNGEGDEFGVLENIWFVDVVQRLGIDRHFQEEIKTALDYIYKFWNHDSIFGDLNMVALGFRILRLNRYVASSDVFKKFKGEEGQFSGFESSDQDAKLEMMLNLYKASELDFPDEDILKEARAFASMYLKHVIKEYGDIQESKNPLLMEIEYTFKYPWRCRLPRLEAWNFIHIMRQQDCNISLANNLYKIPKIYMKKILELAILDFNILQSQHQHEMKLISTWWKNSSAIQLDFFRHRHIESYFWWASPLFEPEFSTCRINCTKLSTKMFLLDDIYDTYGTVEELKPFTTTLTRWDVSTVDNHPDYMKIAFNFSYEIYKEIASEAERKHGPFVYKYLQSCWKSYIEAYMQEAEWIASNHIPGFDEYLMNGVKSSGMRILMIHALILMDTPLSDEILEQLDIPSSKSQALLSLITRLVDDVKDFEDEQAHGEMASSIECYMKDNHGSTREDALNYLKIRIESCVQELNKELLEPSNMHGSFRNLYLNVGMRVIFFMLNDGDLFTHSNRKEIQDAITKFFVEPIIP

SEQ ID NO: 353 - protein, 522 aa, Candida viswanathii
MDQEMSRPKQAAAAAVAPSAAKSVAPEEDEDETSSEELEIKAPVKPLPLEECTRILKEGKVKTLSNAEVSSLVVGGKLPLYALEKQLGDHKRAVAVRRKAIAKLANAPVLETNRLPYSHYDYDRVFGACCENVIGYMPIPVGVAGPLVIDGKPYHIPMATTEGCLVASTMRGCKAINAGGGVETVLTKDGMTRGPCVRFPTLKRAGAAKLWIDSEEGQITIKKAFNSTSRFARLQHIQTALAGTSLFIRFRTTTGDAMGMNMISKGVEYSLKYMVEECGWDDMEVISVSGNYCTDKKPAAINWIEGRGKSIVAAATIPADVVTKVLKSDVDALVELNVSKNLVGSAMAGSVGGFNAHAANLVTAVYLACGQDPAQNVESSNCITLMEKDKQTGDLVISVSMPSIEVGTIGGGTILEPQAAMLDLLGVRGPHPTNPGDNARQLAKIVASAVLAAELSLCSALAAGHLVQSHMQHNRKGATAAAAAAAAPAIANGRANGTKTNGSINGKDLKRLKDGSVTCIKS

SEQ ID NO: 354 - protein, 709 aa, Candida viswanathii; identical to SEQ ID NO: 39

SEQ ID NO: 355 - protein, 662 aa, Candida viswanathii; identical to SEQ ID NO: 36

SEQ ID NO: 356 - protein, 267 aa, Candida viswanathii; identical to SEQ ID NO: 1

SEQ ID NO: 357 - DNA, 906 bp, Chronobacter sakazakii
atgaatgctaatgccgttaagtcctccggtcaggaaatcgaattgcaagctttgagggatgccttgcaaacacgcttggacgaattgctcccacccgggcaggagagagacttggtttgcgcagccatgcgcgaaggggcattgacgccagggaagagagttcgtccattacttttgatcttggcagcgagggacttgggttgcgacgcatcccagccagccttgatggatttagcatgtgcagtagagatggttcatgcggcctcactcatgttggatgatattccctgtatggacaacgcccttttgagacgaggtaaacctacaatccatcgacagtacggtgagtcggtggcaatattggcggctgttgcgttgcttagcagagcattcggcgttgtggcacaggcgaaccctctatctgactcatgtaagacccaagcagtgtcggagctttcctcggccgttggtttgcaggggttggtgcagggtcaatttcgtgatttgtccgaagggaaccaggcaaggagtgcagaagcaattttggccaccaacgatttgaaaacctcagtgttgttcgacgctaccttacagattgcggccattgcggcaggcgcaagtgcgtcagttagacacaagttgagagagttctctcgacacttggggcaagccttccagttgttggacgatttagccgatggattaaaccacacgggaaaggatatcaacaaagacgctggcaagagcacccttgtcgcaatgttgggtccggaagctgtgcaccaacgcttgcgagaccatcttcttcgcgcagatgaacacttgactggtgcatgttcaagaggtgcctccacccgtcgcttcatgtatgcatggtttgacaaacagcttgcaatgtttgggtaa

SEQ ID NO: 358 - DNA, 1479 bp, Chronobacter sakazakii
atgaccaaaacggttgtaataggatcaggatttgggggtctcgcactagccattagacttcaagccgctggtgtaccaaccttgttgcttgagcagcgagacaagccgggaggccgtgcatatgtgtacgaggacaaaggatttacctttgacgccgggcccactgtcattacggacccatccgctatcgaagagttatttacccttgccggtaaaaatatagctgattacgtggatttgttgccagtaacccccttctaccgtttgtgttgggaaaatggtcaagtgtttaattacgataacgaccaagccagtttggaagcacaaatcgcacgttttaacccaagggatgtggagggttaccgacaattcctcgcgtattcacaagcagtatttaaagaggggtacttgaaactaggcgcggttccattcttgagcttcagagacatgttgcgtgcgggaccccaattggccagactccaagcctggaggagtgtctatggtatggttagcaagtttatcgagaacgatcatttgcgacaagctttcagcttccacagtttgttggtgggtggcaacccattcgcaacaagctccatctatacactcatccatgccttggaaaggcagtggggcgtctggtttgccagaggaggcaccggagctttggttcagggcttagtaaagttgtttactgatttggggggagaaattgaactcaacgcaaaggtcaccaggttggatacccaaggagacaaaataagtggcgtgactttggcagatggtaggcggattccagctagggccgtcgcatccaacgcagatgtggtccatacctacaacaatttgttgggtcatcatccgagaggcgtttcgcaagctgcctctcttagaagaaagcgcatgagcaattccctctttgtgttgtatttcgggctcaaccatcaccactcccaattagcccaccatacggtctgttttggaccacgttataaggggttgatagaagacattttcaagagagacagcttggcagacgatttttccttgtatcttcacgctccgtgtgtgacagacccttcattggctccaccaggatgtggatcatactacgtattggctcctgtgccacacttgggtactgcaaacttgaactgggatgtagaggggccacgattaagagacaggatctttgaatacttagaacaacactatatgccgggtcttagagatcaacttgttacacaccgtatgttcactccgtttgactttagagaccaattaggtgcctaccacggttccgctttctccgttgagccaatcctaactcaatctgcttggtttcgcccacacaacagagactctcgaattgataacctttatttggttggagctggaacgcatcccggtgcaggaattccgggtgtcatcgggagcgcgaaagcaacggccggcttaatgttggagggccacgcgtaa

SEQ ID NO: 359 - DNA, 972 bp, Chronobacter sakazakii
atgagtgacaagcctttgttaacacatgctacagagaccattgaggccggatcaaagagttttgcgaccgccagtaagctctttgacgccaagacacgtagaagtgctcttatgttgtacgcttggtgtcgtcattgcgatgacgtcactgacggtcaagccttgggatttagggctgcagacgctcctacagatacaccacaggctcgtatcgcattgttgcgtgctctaaccttggaagcgtatgctggtaaaccaatgcgtgaaccaaactttgcagctttccaggaggttgctctagcacatcagatcccacccgcattggcactcgatcacttggaagggtttgcgatggatgtacgtgaagaacgctaccatacctttgacgataccctaagatactgttatcatgttgcaggcgttgttgggttgatgatggctagagttatgggtgtccgagacgaggctgtcttagatagagcctgcgatttaggtttggcttttcagttaacaaatattgcccgagacattgtcgaagatgcggcaatcggacgatgctatctcccagaggcctggttgcaagaagaaggactttgtgcggatacattgactgacagagcacacagaccagctttggctaggctagccgcacgattggtggatgaggcagagccatactatgcctcagcgagagctggattggccggactcccattaaggtcagcctgggccatcgctactgcccacggggtttacagagaaatcggcgtaaaggtgaagagggctggtgtgaacgcgtgggaaacgcgacagggaacgtcgaaggccgagaaactcgccttgttggccaagggggcggtgatggcagtctcctccagaggagccagttcaagtccacgaccttccgcgttgtggcaaagaccacgcgctcaggatgatcggtacgcgcatgccgcccctcctgccgcttaa

SEQ ID NO: 360 - DNA, 1131 bp, Xanthophyllomyces dendrorhous
atggactacgccaacatcctcactgccattccattggaatttacgccacaagatgatatagttttgttggaaccctaccactacctcggtaaaaaccccgggaaggaaatccgatcacaattgattgaggcattcaactactggttagatgttaaaaaggaggatctcgaggttattcagaatgtagtcggaatgttgcacacagcatcccttttgatggatgatgtcgaagactcttctgtactacgacgtggatcaccggtcgcgcatttgatttacggaatcccacaaaccattaacaccgccaactacgtttatttcctagcttatcaggaaatattcaaattgaggcctaccccaatccctatgccagtcatccccccatcgtcggcctcattgcagtccagcgtaagctcagctagctcctcgtcatctgcgtcatcggaaaacgggggaacatcaacacccaacagtcaaattccattcagcaaggacacctaccttgacaaagtaatcaccgatgaaatgctttccttgcacaggggccagggcttagaacttttctggagagactcgctaacatgtcccagtgaggaagagtacgttaagatggtccttggcaaaacaggggggctattccgaattgctgtcaggttgatgatggctaaaagtgaatgcgatattgacttcgttcaattggtcaatttaatttcgatatatttccagattagagatgactacatgaacttgcaatcgtccgagtatgctcacaacaagaacttcgcggaggatctaacggagggcaagttttcattccctacgattcactcgattcacgcaaatccatcaagtcgtttggtcatcaacactttgcaaaagaagtcaacaagccctgaaatccttcatcactgtgtgaattacatgagaactgaaactcactcctttgagtacacccaagaggtattgaacacactcagtggagccttagagagagaacttggtcggttgcaaggagagtttgccgaagccaacagcaaaatcgacttgggggatgtggaaagtgaaggtcgcacaggtaaaaacgtaaaacttgaggcaatcttgaaaaagcttgccgacatcccattataa

SEQ ID NO: 361 - DNA, 1749 bp, Xanthophyllomyces dendrorhous
atgggcaaggaacaagatcaagacaaacctactgccattatcgtcggttgtggtataggcggcatcgctaccgccgctcgtcttgctaaggagggctttcaagtcacggtgttcgagaagaacgattatagcggaggcaggtgttcgctaatcgaacgcgatggttaccgatttgaccagggtccgagtttgttattgctcccggacttgtttaaacaaacctttgaagaccttggagaaaagatggaggattgggtagacttaataaaatgcgaaccgaactacgtttgtcattttcatgacgaagagactttcacctttagtacggacatggcattgttgaagagagaagtcgagagatttgaaggaaaggatggtttcgacagatttctatcctttattcaagaagcccaccgtcattatgagttggctgtcgtgcacgtcttacaaaaaaatttcccaggtttcgctgcattccttcgccttcaatttataggccagatcttagcattgcacccatttgaatcaatatggacccgcgtgtgcagatacttcaagactgaccgcttgagaagagttttttcgttcgcagtcatgtacatgggtcaaagcccttactcagcgccgggaacatatagtttgttgcagtacaccgagttaacggagggaatatggtacccaaggggcggtttctggcaggttccaaataccttgttgcaaattgttaaacgaaacaacccttcagctaaattcaacttcaatgcaccagtgagtcaggtcctcttgagtcctgccaaagacagagcaaccggagtgaggttggagagtggcgaagagcatcacgcggacgttgtcatcgtcaacgcagaccttgtttatgctagcgagcatcttattcctgatgacgctaggaacaagattgggcaattaggagaggtgaaaaggtcttggtgggcggatttggtgggaggtaagaaactcaaaggttcgtgttcttcattgtcattctactggtccatggaccgaatagtggacggtttggggggtcacaatatctttttggccgaggacttcaagggtagttttgacaccattttcgaggaactaggattgccggctgatccttctttttacgtaaatgttccatctcgcatcgatccgtcagctgccccggaaggtaaggatgccattgtgatactagtgccatgtggtcatattgatgccagcaacccacaagattacaataagttggttgctagggctaggaagttcgtgattcagacattgtcggcaaagttgggacttccagacttcgaaaaaatgattgttgcggaaaaggtgcacgatgctccgtcgtgggaaaaggagttcaacctcaaggatggttcaatcttgggtttggcgcacaacttcatgcaagtgctcgggttcaggccgtcgactagacaccctaagtatgacaaactcttttttgttggagctagcacacatcctggtacaggggttccaatcgtccttgctggtgccaaattgacagctaatcaagtgttggagtccttcgacagatctccagcccccgatccaaatatgagcctatctgttccatacggcaagcctttaaagtcgaacgggacgggcatcgatagtcaagtccagttgaagttcatggatttggaaagatgggtttacttgttggttttgttaatcggagccgttattgccagaagcgttggagttctcgcattttaa

SEQ ID NO: 362 - DNA, 2022 bp, Xanthophyllomyces dendrorhous
atgacggcattggcgtactaccaaatccacttgatttataccttgcccatactagggttgttgggtttgttaacttctccaatccttaccaaatttgatatatataaaatctctatcttggtttttattgcattttcagcaacaactccatgggacagttggataattagaaatggggcatggacttacccttcggccgagtcgggtcaaggcgtctttgggacttttctagatgttccatatgaagaatacgctttcttcgttatccaaacggttataacaggtttggtctacgtcctcgccacaaggcatttgttaccatcgctcgccttgccaaagacacgatcctcggcattaagcctcgcgttgaaggcattgattccgctcccaattatctatttgttcacagcccacccaagtccttcaccagatcccttggttaccgatcattacttctatatgagggcgttgtcactcttgatcacgcctcccaccatgttacttgctgccttgagcggggaatacgcgttcgactggaagtccggccgagcaaaaagcacgattgcagctatcatgattccaacggtatacctaatttgggtcgattacgtcgcagtaggacaggacagctggagtatcaacgacgaaaaaatcgtgggctggcgccttgggggggtccttcctatagaagaggcaatgttctttttgttgacgaatctcatgatcgtgttagggctttcagcatgcgaccatactcaagccttgtatcttctccatggtagaactatttatggtaataaaaaaatgccgtcgtcgttcccattgattaccccgccagtgctttctttgttcttctcaagtagaccgtattcatcgcaacccaagcgtgatttggaattggcggttaagttgttggaagagaaatcccgtagcttcttcgtggcaagtgccggttttccaagtgaagtgagagagaggttggtgggcttatacgcgttttgcagagtcacggacgaccttatagacagtccagaagtgtcctctaacccacacgcgacgatcgatatggttagcgattttttgaccttgctttttggaccacccttgcacccatcccaaccagataaaattttgagctcacctctactcccgcccagtcacccaagcaggcccacggggatgtacccactccccccgccaccgagtttgtctccagccgaattggttcagttcttgacggaacgcgttccagtgcagtatcactttgcgttcaggttgttggcgaaattacaagggttgatcccaagatatccgttagacgagctattgagaggttacaccaccgatttgatattccctttgtccaccgaggctgtgcaagccagaaaaaccccaatcgagactacggcagatcttttggattacggtttgtgcgtagcggggagcgtcgccgagttattagtctacgtttcgtgggcatccgctccatcacaggttccagccactattgaggaaagagaggccgtgttggtcgctagcagagagatgggtacagcgttgcaattagtgaatattgctcgagatattaaaggtgatgccactgagggccgtttctacttgccattgagttttttcggtttgcgtgacgaatcaaaactcgcaataccaacagattggactgaacctaggccacaagacttcgataaattgttgtcgctctccccaagctccactcttccatcatcaaatgcgtccgaatccttcagatttgagtggaagacgtacagtcttcccctagtggcctacgccgaagacttggcgaaacacagttacaagggaattgaccgtctacccaccgaggtgcaggcaggtatgagggcggcgtgcgccagttaccttttgatagggcgcgaaatcaaggttgtgtggaagggtgacgtaggtgagcgacggacggtggccggttggcgaagagtcagaaaagttctttctgtggttatgtcgggttgggagggacaataa

SEQ ID NO: 363 - DNA, 909 bp, Pantoea ananatis
atgacggtgtgtgctaagaagcacgtccacttgactagagacgccgccgaacaattattggccgacattgacaggagacttgaccaacttttgccggttgaaggtgagagggatgttgtgggagctgcaatgcgagagggggctttagccccaggtaagaggataagacctatgttacttctattgacagcgagggatctaggttgtgctgtctcacatgatggtttgctagatttggcctgtgcggtcgagatggtccatgccgccagcctcatcctcgacgatatgccctgtatggatgacgctaaattgagacgtggtcggccaacgattcactcgcactacggggaacatgttgcaatcctagccgcagtcgccttgttgtcaaaggccttcggcgttatcgccgacgccgacggcttgacgccattggcaaaaaacagagcggtgagtgagttgagtaacgctataggtatgcaagggttggttcaaggacaattcaaagatttgtccgagggggacaagccaagaagtgctgaagcaattttgatgaccaatcacttcaaaacatccacattgttctgcgcatctatgcaaatggcatccattgttgcaaacgcctcatcggaggccagagattgtctacatcgattttctcttgatttgggccaagcgttccagttgttggacgaccttacagacggtatgaccgatactggcaaagattcgaaccaagacgcaggtaaaagtacgttggtaaatctcttgggtcctagagctgtcgaggagaggcttagacaacatctccagttagcatccgaacatctatcagctgcctgccaacacggtcacgccactcaacactttattcaagcgtggtttgacaagaagttggcggctgtaagctaa

SEQ ID NO: 364 - DNA, 1479 bp, Pantoea ananatis
atgaaacccacaaccgttattggtgctggctttggcggtttggcattggccataagattgcaagctgccggcatacctgtgttattgcttgaacagcgggacaagccaggaggacgggcgtacgtctatgaagatcagggtttcacttttgatgctgggcccacggttatcacagacccgtcggcgatcgaggaactttttgccttggctggaaagcaattgaaagaatatgtcgagttacttccagttacaccattttatcgattgtgctgggaatccggtaaggtgtttaattacgacaacgaccaaactaggcttgaggcccaaatccaacaattcaacccccgggatgttgagggttatcgccaattcctcgactatagcagagctgtcttcaaggaagggtacttgaaattgggcactgtgccattcttgtctttccgagatatgttacgagcagccccacagttggcgaaattgcaagcatggagaagcgtttacagtaaagttgcttcttatattgaggacgaacatttgagacaggccttttcatttcacagcttgttggtgggaggtaacccattcgctactagctctatttacaccttgattcacgccctagaaagggaatggggtgtttggttcccaagaggtgggacaggcgctttagtgcaaggaatgatcaaattgttccaagacttaggaggggaagtggtgttgaacgcgcgtgtgtctcacatggaaactacagggaacaagatagaagcagtgcatctcgaagacggccgtcgattcttgacacaagcagttgcatcgaatgccgacgtcgttcacacctaccgcgacttgctatctcaacatccagccgctgtgaagcaatccaataaattacaaacaaaaagaatgtcaaactccttatttgttttgtacttcggtctaaatcaccaccatgatcaactcgctcatcacacagtctgcttcggtccaagatatagagaattgatcgacgagatattcaatcatgacgggttggccgaagatttttctttgtatctacacgctccatgcgtcactgatagctctctcgctcctgaggggtgcggttcttactacgttttggcccctgtacctcacttgggtacggcgaacttggattggaccgtagagggtcccaagctacgtgacagaatctttgcatacttagaacaacactacatgccggggttacgcagccaattggttacacatagaatgttcacgccgttcgacttccgagaccaactaaacgcgtatcacggctctgctttttcagttgagccagtgctcacgcaaagcgcatggtttaggcctcacaacagggacaaaacgatcactaacttatacctcgtgggggccgggacccacccaggagcaggaataccaggggtcattggttcggctaaggcgactgccggcttgatgcttgaggacttgatttaa

SEQ ID NO: 365 - DNA, 930 bp, Pantoea ananatis
atgaacaacccctcattgttgaaccatgccgtggagacaatggcagtcggttctaagagctttgctaccgcatcgaaattgtttgatgccaaaactcggaggtcagttttgatgctctacgcgtggtgtcgtcattgtgacgatgttatcgatgaccaaaccctcggcttccaagctcggcagccggcattgcaaaccccagaacaaaggttgatgcaattggagatgaagaccaggcaagcttatgccggcagccagatgcacgaacccgcctttgcggcttttcaagaggttgcaatggctcatgatatagcacctgcttatgcctttgaccacttggagggtttcgctatggacgtcagggaagcccagtatagccaattggatgataccttaaggtactgttatcatgtcgcaggagttgtgggattgatgatggcgcagatcatgggggttcgagacaacgctaccttggatagagcatgtgatttggggttggcgtttcaattgactaatatcgcgcgagatattgtcgacgatgcacacgcaggtagatgctacttgccagcctcttggctagaacacgaaggcctcaacaaggagaattacgccgcccctgaaaatcgacaagctttgtcaagaatagcgagaagattggtgcaagaggccgagccatattatttgagtgcgacagctggtttagccggattgccattgaggagtgcatgggccatagccacggcgaaacaagtataccgtaaaataggggtcaaagtcgagcaagctggtcagcaagcatgggatcagcggcaatcaaccacaacgccagagaagttgactttgctcttggccgccagtggacaggctctaacctcccgtatgagagcccatcccccaaggccagctcacttgtggcagaggccattgtaa

SEQ ID NO: 366 - DNA, 2241 bp, Xanthophyllomyces dendrorhous
atggcaaccctatctgacttggttatcttgttgttgggtgccttgttagcattggggttctataacaaggacagattgctcggttcaagttccagcagtgcctctaccacatcaggttcaagcgctgcaactgctaacggtagtaagcccacatattctaatggcaacgggaacgcctttaaaggcgacccacgagatttcgtcgcgagaatgaaggatcaaaagaaaaggttggcagttttttatgggtcccaaactggaactgctgaggagtacgccacccgaatcgccaaggaagcgaaatctcgtttcggcgtttcgagtttggtgtgtgacattgaggaatatgattttgaaaaattggatcaagtccccgaggattgcgccattgttttttgcatggctacctatggtgaaggtgaaccaacagacaatgctgtccaattcatcgaaatgatcagccaggatgacccagagtttagtgaaggtagtactttggatggtttgaagtacgttgtctttggattggggaataagacatacgagcaatacaatgttgtcggccggcagttggacgctagattaaccgcacttggtgcgaccagagtaggtgagcgaggtgaaggagatgatgacaaaagtatggaggaagattatctcgcatggaaggatgatatgttcgccgctttggccaccacattaagttttgaagagggagcttcgggggagactccagatttcgtggtcactgaagtcccgaaccaccccatcgaaaaggtcttccagggcgaattgtccagcagagccttgttgggctctaaaggcgttcacgacgccaagaatccatacgcttcgccagttttggcctgccgggaattattcacaggcggagatcgaaactgtatccaccttgagtttgacatcaccgggtccggaatcacctaccaaacaggtgatcacgtcgcagtttggccatccaatcctgacgttgaagtggaaaggcttttggcagtgttgggtctcacatctccagagaagagacggatgattatccaagtggtgagccttgatccaactttggccaaggttccattccctacaccaaccacctatgatgccgttttcagacattaccttgacattagtgcagtggcttcacgccagaccttggctgtccttgccaaatacgccccttccgaacaggctgccgaattcttaaccaggttgggaactgacaagcaagcgtaccatactgaagtggttggaggtcacctaagattggccgaggtgcttcaattggctgcagggaacgatattactgttatgcctacagctgaaaatacaaccgtctggaacataccattcgaccacgttgtgtctgacgtttcccgcttgcaaccccgattttactcgataagcagttctcctaagcttcacccgaacagcattcacgtaacggctgtgatacttaaatacgaaagtcaagccactgaccgtcacccagcgagatgggtgtttggtttggggacaaactatttgcttaatgttaagcaagcagcaaacaatgaaaccactccaatgatctctgacggacaagacgatgtgccagaacacgtgtcagcgccaaaatacacgttggagggaccccgtggctcctataagcacgacgatcaattgtttaaagtgccaatccatgtgcgtaggtccactttcagacttccaaccagccctaagatccctgtgatcatgattgggccaggtaccggtgtcgctcctttcagaggattcatccaagaaagaattgcccttgccagaaggtccattgctaagaatgggcctgacgccttggcggattgggccccaatctatcttttctacggtagtcgcgatgagcaagacttcttgtacgcggaagagtggcctgcttatgaagcggagttgcaagggaaattcaagattcatgttgctttcagtagatccgggccaagaaagccagatgggagtaagatttacgtgcaagatcttttgtgggatcaaaaggaagtcatcaaatctgccatagtggaaaaacgtgcatctgtttatatttgtggggacggtcgaaatatgtcgaaagatgtcgagcagaagttggccgcgatgttggccgaaagtaaaaacggtagtgcggccgtggaaggagccgcggaagtcaagtcattgaaagagagatctcgattattgatggatgtgtggagctaa

SEQ ID NO: 367 - DNA, 1674 bp, Xanthophyllomyces dendrorhous
atgttcattttggtgttgttgaccggtgctttgggtttggcagcttttagctgggcttcgattgccttcttttctctttatttggcgccccgtcgcagtagcttgtataatttgcaaggtccaaaccacactaactatttcaccggcaattttttagatatactctcggctaggacgggtgaggagcatgctaagtatagggaaaaatacggatccacgttgagatttgccggcatcgccggtgccccagttttgaactcaactgatccaaaagtcttcaaccatgtgatgaaggaggcatatgattacccaaaacctggtatggctgcgagagtgttgaggattgcaacgggtgacggagtggttacggctgagggtgaggcacataaacgacatcgaagaatcatgatcccttccttgtcagcacaagccgttaagtccatggttcccatcttccttgagaagggcatggagctcgttgacaagatgatggaggacgcagccgagaaagacatggcagtgggcgaatccgcaggtgagaagaaggctactcgacttgaaacggaaggcgttgacgtaaaggactgggttgggagagcaactttggatgtcatggctttggccggatttgattacaaatcagattcgctacaaaataagacgaacgaattgtatgtcgctttcgtggggcttacagacggatttgcacccaccttggacagttttaaggccatcatgtgggatttcgtgccgtactttcgcacaatgaagagaagacatgagattcccttgacccagggtttggctgttagtcgccgtgttggcattgaactaatggagcaaaagaagcaagcagtgttgggttcggcatcggatcaagccgtggacaaaaaggacgtgcagggacgcgacattcttagtctcttggtcagagcgaacattgccgcaaatcttcccgaatctcaaaagttgtcggacgaagaggttcttgctcaaatttcgaatttgctattcgcgggttatgagacttcaagtactgttctcacatggatgttccatcgattgtcggaggacaaagcagtgcaagataaattaagggaggaaatctgtcaaatagatacagacatgccaacactagacgagttgaatgcattgccgtacttggaggcgtttgtgaaagagtcactaagactcgatcccccgtctccatatgctaatagggagtgtttgaaggatgaagatttcattccattggccgaacctgtcattggacgcgatgggtccgtgatcaatgaagtcagaatcacaaaggggacaatggtgatgcttccattgttcaacatcaatagatcgaaattcatatacggtgaggacgccgaagaatttagaccagaaaggtggttggaggatgttaccgactcccttaacagcatagaagctccatatggccatcaagcgtccttcatatcaggaccaagagcctgctttggatggcggttcgcggtcgcagaaatgaaagcattcttgttcgtaacactaaggagagtgcaatttgagccgatcataagccatccagagtacgaacatattactctcattatcagcagaccccggatcgttggcagagagaaggaaggatatcagatgcgtttgcaggtaaagccagtggagtaa

SEQ ID NO: 368 - DNA, 489 bp, Agrobacterium aurantiacum
atgacaaacttcttgatcgttgtggccaccgtgcttgttatggaattgaccgcctactcggtgcatagatggataatgcacggaccattgggttggggatggcacaaatcacaccatgaggaacacgatcacgccttagaaaaaaatgacctctatggcttggtgttcgctgtcattgcgaccgttttgttcaccgtcggttggatctgggcaccagtgttgtggtggattgcacttggtatgacggtttatggcctcatatattttgtgctccacgatggtctagttcaccaaaggtggcctttcagatacattcccaggaagggttatgcacggcgattatatcaagcccatcgtcttcatcacgctgtggagggaagggatcactgtgtcagctttgggttcatctacgcaccacccgttgacaagttgaaacaagatttgaaaatgtctggtgtcttgcgggctgaggcccaagagaggacgtaa

SEQ ID NO: 369 - DNA, 729 bp, Agrobacterium aurantiacum
atgagtgcccatgccttgccaaaggcagatctaactgccactagtttaattgtgtcgggcggtattatcgcggcttggttggcattgcatgtacatgcattgtggttcttggacgcggcagcgcaccctatcctcgcaatcgccaattttcttggactaacgtggttgtcagtaggtctatttatcatcgcccacgatgcgatgcacggatccgtagtccctggtagacctagagcaaatgctgcaatgggccagttggtgctttggttgtacgctggcttcagttggagaaagatgattgttaagcatatggcacatcaccgtcacgcaggtaccgatgacgacccagattttgatcatggaggtccagtgcgatggtacgcacgcttcataggaacctactttggctggagagaaggtttgcttttgccagtcatagtaaccgtctacgctttaatacttggagatcgatggatgtacgtcgtgttctggccattgccatcaatcttggcctctatccaattgttcgtttttgggacttggttaccacatagacccggtcacgatgcattcccagatagacacaacgcccgatcatccagaatatccgatccagtttctttgctaacttgcttccacttcggtggttatcaccacgaacaccatttgcatccgacggtcccatggtggaggttgcctagcactagaactaaaggtgataccgcttaa

SEQ ID NO: 370 - DNA, 1770 bp, Callitropsis nootkatensis
atggcagaaatgttcaatggaaacagcagtaatgacgggagctcatgtatgccggtaaaggatgcattgagacgtacgggcaaccaccacccaaatttgtggactgacgatttcattcaatcgcttaatagtccatactcggactcctcctaccataaacatcgcgaaatattgatcgatgagattcgcgatatgttttcaaatggggaaggggacgaatttggcgtgttggaaaatatttggtttgtcgatgttgttcaacggttaggaatcgaccgtcactttcaggaagagattaaaacagcgttggactacatctacaagttttggaaccacgactcgatatttggtgaccttaacatggtcgctttgggtttcagaatcctaagattgaaccgttacgtggcaagcagcgacgttttcaagaagtttaagggtgaagagggccaattttcaggcttcgaaagttcagaccaagatgcgaagttggaaatgatgctaaacttgtataaagcaagtgagctagattttccagacgaggatatccttaaggaagctagggcctttgcgagtatgtacttaaagcacgtaatcaaggaatacggtgatatccaagagagcaagaacccattgcttatggagatagaatacacattcaagtacccatggcgttgtcgtttgcctcgacttgaggcttggaatttcattcacattatgagacaacaagactgtaatatttcattggctaacaacctttacaagattccgaagatatacatgaaaaagatcttggagttggccatcttggactttaatattctccagtcacaacaccaacatgaaatgaaactcatctccacgtggtggaagaactctagcgctatccaattggactttttcagacaccgccacatcgaaagctacttctggtgggcttcaccgttgttcgagcccgagttttctacatgtcggatcaactgtacgaagttgtcaactaaaatgtttctacttgacgatatatacgacacatacggtactgtggaagaactaaagccgtttacgaccacattaacgaggtgggacgtgtctacagtcgacaaccatccagactacatgaagatcgcttttaacttcagctatgaaatctacaaggagatcgcctccgaggcggaacgtaaacacggtccattcgtgtataaatatttgcaatcatgctggaagtcctatatagaagcttacatgcaagaagcagagtggattgcttcaaatcatattccaggcttcgatgagtacctcatgaatggtgtaaagtcatccggcatgagaatattgatgatccacgcattaatcctaatggatacaccattgagcgacgagattttggaacaattagatataccgagttcgaagtcacaggccttgttgtcgttgattaccagactcgtggatgatgtcaaggactttgaggacgaacaagcccatggggaaatggcatcctccattgaatgttacatgaaagataaccacggttcaacaagagaagatgcattaaactacttgaagatccgaatcgagtcgtgtgtccaggagttgaataaggaattgttagaaccttcgaatatgcacggtagttttaggaatctttatttgaatgttggcatgcgtgtcatatttttcatgctcaacgatggggacttgttcactcattcgaacaggaaggaaattcaggatgccatcaccaagttcttcgtcgaaccgattataccttaa

SEQ ID NO: 371 - DNA, 1212 bp, Candida viswanathii
atgaccctcccaccagtctacatcgtctccacagcaagaactccaattggttccttccaaggttcgttatcttccttgacctactccgatttgggtgcccacgccgttaaggcagctttagccaaggtcccacagatcaagccacaggacgtcgacgagatcgtctttggtggtgtcttgcaagccaacgttggtcaggcaccagccagacaagtcgccttgaaggcaggcttgccagactctatcattgcctccaccattaacaaagtctgtgcctccggtatgaaggccgtcattatcggtgcccaaaacatcatctgtggaaccagtgacatcgtcgttgttggtggtgccgaatccatgtctaacactccatactacttgccaagcgccagaagcggggccagatacggtgacgccgtcatggttgatggtgtccagaaggatggtttgttggatgtctacgaagaaaaattgatgggtgttgctgctgaaaagtgtgccaaggaccacggattcagcagagaagaccaggacaactttgccatcaactcttacaagaaggctggcaaggctttgagtgaaggtaagttcaaatcagaaatcgccccagtcaccattaaaggattcagaggcaagccagatactgttattgaaaatgatgaagagattggcaaattcaacgaagacagactcaagtctgccagaactgtcttccaaaaggaaaacggtactgttactgctccaaacgcttctaaattgaacgatggtggtgctgccttggtcttggtttctgaagccaagttgaagcaattgggcttgaagccattggccaagatctctggttggggtgaagctgccagaactccattcgatttcaccattgccccagctttggctgttccaaaggctgtcaagcacgctggtttgaccgttgacagagtcgacttctttgaattgaacgaagccttctccgttgttggtttggccaacgctgaattggtcaagatcccattggaaaaattgaacgtctacggtggtgctgtcgccatgggtcacccattgggttgcagtggtgctagaattattgtcaccttgttgtccgtcttgacccaagaaggcggtagatttggtgctgctggtgtctgtaacggtggtggtggtgcctctgccatcgtcattgaaaagattgactccgatgccaagttgtaa

SEQ ID NO: 372 - DNA, 1350 bp, Candida viswanathii
atgactaacgcaccacaaaacattggtatcaaaggaatcgaagtctacattccaggccaagctgtcaatcaatcagacttggaaaaattcgacggcatcccagccggcaagtacaccatcggcttgggccagacaaacatggcttttgtcaacgacagagaggacatctactccatcgccttgactgttgtctccagattgatcaagcattacaatgttgacaccaacaacgtcggtcgtttagaggtcggtaccgagaccttgttggacaagtccaagtctgtcaagtccgtgttgatgcaattgttccccgacaacaacgacattgaaggtatcgacactgtcaacgcctgctacggtggtacctccgctgtcatcaatgccatcaactggatcgagtcgtcttcctgggacggcagagacgccattgttgttgctggtgacattgctatctacgacaagggtgctgctagaccaactggtggtgctggttccattgctatgttgattggtcctgacgctcctattgtctttgactctgtgcgtggctcattcatggaacacgcctatgatttctacaagccagacttcaccagtgaatacccagttgtcgatggtcacttctccttgtcctgttacgttaaggctgttgacaactgttacaagaactactccaagaaggtcaccggcaacgtcgacaagaccgtcggcgtttacgaccactttgactacaacgctttccacgtgccaacctgtaagttggtcaccaagagttacgccagattgttgtacaacgactacaagtcggatccatccaagtttgctgacttgattgacgaaagcaccagacaacacattgacagtttgtcctacgaagcatccttgaccgacaaggtcttggaaaaaactttcgtcacattggccaaagaagagaccaaaaagagagtgcaaccagccttgcaagtgccaaccaacaccggtaacatgtacactgcttcgtcatgggtctccttggcctcgttgttgtactatgttggcgctgaaaacttgaaagaaaagagaatcggtctcttctcctacggttcaggtttggcctccaccttgttgtccgtcactgttgtcggcgacgtttctccaatcaccaaggtcttggacttcgactacaaattaggcgaaggaagaaagatccagagcccagaagaatacttggctgccattgaattgagagaaaaggcacacttgcaaaagagcttcaagccacaaggttccctcgataacttgagccaaggcacctactacttgactgaggttgacgacaagtttagaagaagttatgctataaaggaataa

SEQ ID NO: 373 - DNA, 3120 bp, Candida viswanathii
atgctaagtttcatcaccgaagcaagtggcagaatagcccagactgcagcccacagaccaattcacttcatggtgatacctgcgttactagcatccatagcatacttgtccatcatcgatgattacgtccccgaacacatcagagcccagtacatgtcaggcgtcagctatttccaccctcaagggtccgcctcggatttggacaagtggatcgaaatccacgacactacccaatacgccaacgccaaccaaatcagtgtcatccctttgagattcagacgattccatgactcaatcccacagatcgctaacgccatcaagatttcaaacaatgaacagatcttgattgttccttcggataaagcagagtcgacagtagaaggtttgagcgagatcactgagaatggcatcacttggagggctagaaataacgacaagttgtccaagtattatgattacgccaggtacgggttgcttagaatccaggacgctatacacaatgctgataatttcgacatcctcttggtgtttgttgcctaccttggaatgtggtactcacttatcaaagtgtttattgacatgagacgcattggctccaagttttggttagcctttggcacgttgacttcctcgactttttcattcttgtttgccttggtcatttcaaacaaatttttggacgctaaagtttccttgagaagtctttctgaatgcatcccatttttggttgccattattgggttcaaacataaagtggccatcacgactagtgttgcccagtcatccacttcttcacccgaggatgttcctcatgtcgtgggcaaagctgtctcagaccagtgtttgtttatcttgagagaccatttggttgtcattattggatttctcgcctgtgcggcttatggcaatgaattgaaaggtttaagaaacttctgtatcttgggggcattgattttgtcctttgacattgtttccgtttatactttcttttctgcgattttggccttgaaagtcgagattaaccgtgcccgccgtactcaagatttacaacacgtattggaagaggacggcatttcatccttagttgccgctagagttgccgaacgaaatgcaactattgaacaccccaacgaaaccaacttcttctcatctaataattcttccattgtttatttcaaagttattatgagtcttgggtttttcgccttccatgcattttggttgggcagctcgtggttatacaacacttctgatggcggtagccatggaagcttttcgttcctcagcaacatcccattattgacacaagacatctccaactccatcccaattggcagaagaggaaccgtggttaccattttgccaaccaccttctacatgccatccggtatcatcatccaatttgaagatatggtctacttagcattgagcaagatcagcagtgctatcagagacagtttgatttccaagtgtattgtgtttgcattgaccatttccattgtcaccaacatctacttcttgaatgctgcccgtttccaagtttcagctacccgtaagttgattgaccaagaaatgtctcgtccaaaacaagccgccgccgccgctgctgctgctccatctgctgcaaaatcagtggcgccagaagaagacgaagacgaaacctccagtgaagaacttgaaatcaaagctcctgtaaagccgttatcacttgaagaatgtaccagaatcctcaaagagggcaaagtcaagaccttgtccaacgctgaagtgtctagcttggttgttggcggtaaattgccattgtacgctttggagaaacaattgggcgacaacaagagagccgtggctgttcgtcgtaaggctattgcaaaattagctaacgcgccagtattagaaaccaaccgtttgccttactcccactatgattatgatagagtctttggtgcttgttgtgagaatgttattgggtacatgccaatccctgttggtgttgctggaccattagtgattgatggcaagccataccacatccccatggccactaccgaaggttgtcttgttgcctctactatgcgtggctgtaaagctattaacgctggaggtggtgttgaaaccgtcttaaccaaagatggtatgactagaggtccttgtgttcgtttcccaactttgaaaagagccggtgctgcaaagttgtggattgactccgaagaaggtcaaatcaccatcaaaaaggcattcaactcgacttctagatttgctcgtttgcaacatattcaaactgccctcgctggtacctcgttgtttattagatttagaactactactggtgatgctatgggcatgaacatgatttccaaaggtgttgaatattccttgaagcacatggttgaagaatgtggctgggacgatatggaagttatctctgtttctggtaactactgtaccgataagaaaccagctgctattaactggattgaaggtagaggtaagtctattgttgctgctgctaccatccctgctgatgttgtcactaaagtcttgaaatccgatgtcgatgccttagttgaattgaatgtttccaaaaacttggttggctcagccatggccggttcagttggtggtttcaatgctcatgcagccaacttggtcactgctgtttacttggcctgtggtcaagaccccgcacagaatgtcgaatcctcaaactgtattaccttgatggaaaaggacaaacagactggcgacttggtcatttctgtttctatgccatctattgaagttggtacgattggtggtggtaccattttggaaccacaagcagccatgttggacttgttgggcgtgcgtggccctcacccaaccaatccaggtgacaatgcaagacaattggccaagattgttgcttcggcagtgttagcagctgaattgtcactttgttctgctttggccgctggtcacttggtgcaatcccacatgcaacacaaccgtaaaggagccaccccagctgcggcccctgcaatcagcaacggaagtgccaagggaaccaaaaccaatgggtctataaatgggaaagacttgaagcgtctcaaagacggatccgttacatgtataaagtcatag

SEQ ID NO: 374 - DNA, 1299 bp, Candida viswanathii
atgtcagtctcgcctttcgttgtcagtgctccagggaaagtcatcatctttggagaacattcagcagtttatgggaaacccgccattgcagccgccttgagtttgcgatgttacctactcgtttccccgtcagttgatgatgcaaacacaatcagattgcagttcccagacatccaattggaccattcctggaacatcaacgatatcccctgggatgaaatcaaaccgttcgttaaatatgacgccaataacaaaccactcaccccatcggagttggtaccagagatcctcgataagttgtctcccttgttgactgatttcgataacaaaatgcattactacgcttgtttttgtttcctttacttgtacgtcaatttatgttccactgaaactccaggaaccaccttcatcgtcagatccaccttgccaatcggtgccgggttagggtcgtctgcatccacgtctgtgtgcttgtcgtctgcattagcattgttaggcggctgtatcagtgagccttcgatatcagccaccgacaagatcctcaacgaagacatacccgatttggagttcgtcgataagtggtccttgataggtgagaagtgcttccacgggaacccatccggtatcgacaacgcagtagccacgtttggcggtgccgtcatgtttcaaagaacttcggctcctgagcaaccatccatcagaaccaacatgagaaacttcccagctatcaaactcttacttacaaacaccaaagtcccaaaaagtacagctgatttagtcgccggtgttggcaaactcaacgcggagttcaacccgataaccacgtcgattttgaccgctatggagcatttgtcacaggaagcttacaaagtcatgatcactccggggttcggcaaggacgaaacaaacacgttgcgtaagttggtcaatatcaaccatggtctattggtagcgttgggcgtgtcacatccgtcgctagaaaccgtcaagatcattggtgacagacacaagattggcgctactaagttgactggcgctggtggtggcgggtgtgcgatcactttggttaatgataatgtcgaggagtctgttatccaagaagctatcaaagagtttgcaactgagggatatgagagttttgaaacgtcgttgggtggtaaaggtgtcggtgtcctatttagtggtgatgtttctgataatggcaagttttctcaatctgtgttctgcaactatcccgaccgtgctagcattgaagatgctttaggaatgataaacgttaaagaatggaagttctggtga

SEQ ID NO: 375 - DNA, 1263 bp, Candida viswanathii
atgtcaaaagcttttagtgcccctggtaaagcattgttagctggcggatacttggttcttgagccaacatatgatgcatatgtgacggcattgtcctcgagaatgcacgctataataacaccccagaagccagcatccatttcaaaaatcaaaatcagttcgcctcagtttgccaatggtgagtgggagtatcacgtcacgtctaatgagaaacccaaggacatcaagtccagaagcaatccgtttttggaggctaccattttcattgttttgtcttatatccaaccaacagaaccattcgatctcgatttggtcatatattcagacccaggataccattcacaagaacacaccacgcagaaagtgtccagcaacggcaagaaaaagttcctttatcattcgcgtgcaattaacgatgttgagaagacaggattaggttcttcggccggtctagtttctgtcgtcactaccagtttgttatcctactttattccgggaattgaagagtcaaacaaggacatgttgcacaatgtagcacagattgcccattgttttgcccagaagaagattgggtccgggttcgatgtggccactgccatctatggtctgattgtctaccgaagattccagccaagcttgatcaacgacgttttcgagatcttagaggaaaccccgggtagattccccggtgctttgaagtcgttagttgagtctaattgggaattcaaacatgaaaggtgcgtactaccaccaaagatcaagctcttgatgggagatatcaaaggaggatcagagactccgaaattggtttccaaaatactccaatggaagaaggacaaaccagaagaaagtgggttggtgtatgatcaacttaatagcgcaaatgtggcgttcatgaagaagatcagtacattgaatgaatcgagtcaggtccaagagattgacgaattgtctgattacataagcgcggtacgcaaagggttgcaagaattgacagaaaaatccaaagtcccagttgaaccacctgtgcaaactgaattgttggaccgcattgcaaaactcccaggttgtctaggtggggttgtgcccggtgctggtgggtacgatgctatagctgtgcttgtgttggaaaaggaggttgagaactttagaaacaagacacttgaaaacccagagtactaccacaacgtgtactgggttgacttggaggaagaaaccgagggtgtagtggtggaaaactgggaggactatatcggtttatag

SEQ ID NO: 376 - DNA, 1166 bp, Candida viswanathii
atgtattcagcttcagtcacagcacctgtcaacatagcggtatgtatgttcccacctagttgctcctccccgactcatcactaacacccttatagaccctcaagtactgggggaaacgcgacaagaccctaaacttgccaaccaactcctccatatcagtcaccctctcccaggatgatttgcgaaccttaaccacagcagcagcgtccaccactttcgacaaggaccaattgtggctcaatggcaagttggagtcgttggacactccgagaacgcaagcgtgcttggtcgatttaaggaaattgagagccgatgttgagcaagccaacgctgacctcccaaagctttccacgatgaagctccacattgtttcggaaaacaacttccccaccgccgctggtttggcttcctcggctgctgggtttgctgcgttgatcacagccatcgccaagttgtacgaattgccccaagacatgtcggagttgtccaagattgctcgtaaaggttctggttctgcgtgcagatccctctttggcgggtttgttgcgtgggagatgggcgacgccgccgacggacaagactccaaggcagttgaagttgcgcctttggaccactggcctagcatgagggcggttattttggtggtcagcgacgacaaaaaggacaccccaagcaccaccggtatgcaagccaccgtgcaaacctccgacttgtttgcccaccgcgtcaccaaagtcgtcccccagtgtttcgaagagatgaagaaggccatcgtcgccaaggactttcctaaatttaccgagttaaccatgaaggattccaactcgttccacgctgtttgtttggactcgtaccctccaatcttctacctcaacgacacctccaagaagatcatcaagttggtggaggccatcaacaagcacgccaccatcgctgcctacacgttcgacgcgggccccaacgccgtcatctactacgacgccgctaacgaagacgaggtcttgtcccagctctacaagtcgtttggccacgttcaaggatggaagaaagcctacaccgcggaaacagccgttgccggtgtttcacgtattattcaaacatctattggtcaaggaccgcaagttacaaacgaatcattaatcaacgaaagtgggttaccaaactaa

SEQ ID NO: 377 - DNA, 861 bp, Candida viswanathii
atgtcatcagaatacgctaaactagtggcaagtttctccccaaacgacatattggctaaatggccagaggtcactccattgaagaagatatcaggcatcccaagatcagccgagtcagacagctccaacggctcccacaacaacacagaacttttcaatggccacgacgaggagcaaatcagattgatggaggagctttgcattgttttggactacgacgacaagcctgttggggcaggaacaaagaagttgtgtcatatcatggacaatatcaacgaaggattgttgcaccgtgccttctcggtgtttttattcaatgaggacgggaaattattattacaacaacgtgccgatgaaaaaatcaccttccctgccatgtggacaaatacttgctgttcccatcctttgtgtgttcctagtgagttgggggttgatgccgatgccaaagatgtcaacaacttggataacgccgtgcatggagccaaggtggccgcacaaagaaaattggaccatgagttgggcatcccattcagtgacactcccttggaccagttcacgtacttgactagaattcactataaatcagccagtggtgcagaagactccaaatggggtgagcatgaaatagactatattttgatattgaagaccaagaatgacatcaccatcaatgccaactataatgaagtcaaggattataagtatgtggacgccaaggagttgcaggagatgtttgaagataaggacttggtgttcaccccgtggtttaaattgatctgtcaatctttcttattcaaatggtggaataatttaagtgatttagaaaagtaccaagatactgagatacatagattactttaa

SEQ ID NO: 378 - DNA, 1056 bp, Candida viswanathii
atgtctgataaagcagccgctagagagagattcctctctgtttttgagtgtgccgtcgaggaattgaaagaagtcttggtttctcacaagatgccgcaagaagcaattgactggtttgtcaagaacttgaactacaacacccccggcggtaagttgaacagaggtttgtctgttgtcgacacctacgctatcttgaacaacaccaccgctgacaagttgaacgatgaacaatacaagaaggtcgccttgttgggctggtcaattgaattgttgcaagcttactttttggttgccgatgatatgatggaccaatccaagaccagaagaggacagaaatgttggtacttggtcgaaggtgttggaaacattgcaattaatgactccttcatgttggaaggtgccatttacgtcttgttgaagaagcacttccgtcaagatccatactatgtcgacttgttggacttgttccacgaagtcaccttccagaccgaattgggtcaattattggacttggtgactgctgatgaagaagtcgtcgacttggacaagttctccttggacaagcactcgttcattgtcattttcaaaaccgcatactactccttctacttgcctgttgctttggccatgtacatgagcggtatcagcagcgaagaagacttgaagcaagtcagagatatcttgatcccattgggtgagtacttccaaatccaggacgatttcttggactgtttcggaaccccagaacaaattggcaagatcggtactgatatcaaagacaacaagtgttcctgggtggtcaaccaagctttgttgcatgctactccagaacaacgtaagttgttggacgacaactacggtaagaaagacgacgagtctgaacagagatgcaaggacttgttcaagtccatgggcattgaaaagatctaccacgactacgaagagtcaattgttgctaaattaagagaacaaatcgataaagttgatgaatcaagaggtttgaaaaaagatgtcttgaccgctttcttgggcaaggtttacaagagatccaaatag

SEQ ID NO: 379 - DNA, 996 bp, Candida viswanathii
atgtcattcaacatcgatagcttaatccaaccaggcgccgcctacgacccatctatgaccgacgccatcatgaagccatacaggtacatctccgaggtccccagcaacaaccacaacgtgcgtacgcgcttcttgcttgcattcaacgagttgttctacggcatgaagaacgaggacttgctccaccgcatcagccacatcatctccgtgttccacaactcgtccttgttgatcgacgacatcgaggacgactcgcagttgcgccgcggcatgccggtggcacacgtcaagtacggcgtcccgttgaccatcaactgcggcaacatgatgtacttcgtcgcggtccagaaagcgattgacttggcgggcgaggctgggtccgcggagttgaagttcgagacgtcgcagatcttggttgacgaaatgatgaatgttcaccatggacaaggcttggatatttactggagagactacttgaaggacctcgagcacttgcctgagatcgaggattacttgggcatggtcaaggacaagactgggagcttgttcagattggccatcaaattgttgctgttgcattcggacgtgggcgaggacaatggtttggtcgcgattgccaacttgttgggcataatctaccaaatcagagacgactacttgaacttggtcgatatcaagtactccgccatgaagggcgttacttgtgaagacttgattgaaggtaagttatccttgcctattttgcattgcttgagaaccacgactaattccccggttcacgagatcctatacaactacaacaccagcgctgagcgcgccaaacagaacgccttgattgaagagtgcttgacttacatgaagaacaagtcgagatccttgcaatatactttggacttgatcaagaccttggagcgcaagatcaaggctatgatgaccaagtatccaaacctggagaactccggcttgataaaaatcattgacaggttgtgtgatctt

SEQ ID NO: 380 - DNA, 855 bp, Candida viswanathii; identical to SEQ ID NO: 71

SEQ ID NO: 381 - DNA, 2091 bp, Candida viswanathii; identical to SEQ ID NO: 91

SEQ ID NO: 382 - DNA, 1953 bp, Candida viswanathii; identical to SEQ ID NO: 98

SEQ ID NO: 383 - DNA, 1566 bp, Candida viswanathii
atggaccaagaaatgtctcgtccaaaacaagccgctgctgctgctgttgctccatctgccgcaaaatcagtggcgccagaagaagacgaagacgaaacctccagcgaggaacttgaaatcaaagctcctgtcaagccattaccacttgaagaatgtaccagaatcctcaaagagggcaaagtcaagaccttgtccaatgctgaagtgtctagtttggttgttggtggtaaattgccattgtacgctttggagaagcaattgggcgaccacaagagagccgtggctgttcgtcgtaaggctattgcaaaattagctaatgcgccagtattagaaaccaaccgtttaccttactcccactatgattatgatagagtttttggtgcttgttgtgagaatgttattggatacatgccaatccctgttggtgttgctggaccattagttattgatggcaagccataccacatccccatggccactactgaaggttgtcttgttgcctctactatgcgtggttgtaaagctattaacgctggaggtggtgttgaaactgtcttgaccaaagatggtatgactagaggtccttgtgttcgtttcccaactttgaaaagagccggcgctgcaaagttgtggattgactccgaagaaggtcaaatcaccatcaaaaaggcattcaactcgacttctagatttgctcgtttgcaacatattcaaactgccctcgctggtacctcgttgtttattagatttagaactactactggtgatgccatgggtatgaacatgatttccaaaggtgttgagtattccttgaagtacatggttgaagaatgtggctgggacgatatggaagttatctctgtttctggtaactactgtaccgataagaaaccagctgctattaactggatcgaaggtagaggtaagtctattgttgccgctgctaccattcctgctgatgttgtcactaaagtcttgaaatccgatgtcgatgcattagttgaattgaatgtttctaagaacttggttggttcagccatggccggttcagttggtggtttcaacgcccatgcagccaacttggtcacagctgtttatttggcctgtggtcaggaccctgcacaaaacgtcgaatcttcaaactgtattactttgatggaaaaggacaaacagactggtgacttggtgatttctgtttctatgccatctatcgaagttggtacgattggtggtggtaccattttggaaccacaagcagccatgttggacttgttgggcgtgcgtggtcctcacccaaccaaccctggtgacaatgcaagacaattggccaagattgttgcttcggcagtgttagcagctgaattgtcactttgttccgctttggctgctggtcacttggtgcaatcccacatgcaacacaaccgtaaaggagctaccgccgccgccgccgccgcagcagcccctgcaatcgccaacggccgtgccaatggaaccaaaaccaatgggtctatcaatgggaaagacttgaagcgtctcaaagacggatcagttacatgtataaagtca

SEQ ID NO: 384 - DNA, 2130 bp, Candida viswanathii; identical to SEQ ID NO: 93

SEQ ID NO: 385 - DNA, 1989 bp, Candida viswanathii; identical to SEQ ID NO: 92

SEQ ID NO: 386 - DNA, 804 bp, Candida viswanathii; identical to SEQ ID NO: 54

SEQ ID NO: 387 - DNA, 1125 bp, Candida viswanathii
atgtccgttaaaaccaaaaccatcactattctcccaggtgaccacgtcggtaccgagatcgttgccgaggcaatcaagtccttacatgccattgagtccctgaccccataccaaaaagttcattttgagttcaagcaccacttgataggcggtgccgccattgacgccactggtgtgccgctcccagacgacgccttagccgccgccaagtcctcagacgccgtgttgctcggggccgtcggtggacccaaatggggaaccggcgctgtgcgtccagaacagggattgttgaagatccgtaaggagttgaacctttatgccaacatcagaccatgcaatttcgctagcgactccttgcttgagctctctccgttacgtcctgaggtcgtcaagggcaccaacttgatcattgtgcgtgagctagttggtgggatttactttggtgagagacaggagcaggaagaaagcgaggatgggaaatcggcttgggatactgaaaagtacaccgttgatgaagtcgcgagaattacacgcatggctgcgttcatggcattgcaacacaccccaccattgccaatctggtccttggacaaagccaacgtgcttgcctcgtcaagattgtggagaaagacagtggataaaatcatcagtgaagagttccctaccttggctgtccagcaccagttgattgactccgcggctatgatcttgatccagaacccaacgaagttgaacgggatcatcatcacgtcgaacatgtttggtgatatcatatccgatgaagcgtccgtgatcccagggtccttgggattgttgccatctgcgtcattggcttcgttaccggacacaaacactgcgtttggtctctatgagccatgccatggttcggcacctgatttgccagagaacaaagtcaaccctattgcgacaatcttgtccgttgctagtatgttgagattgagtttggattgtgttaaggaagccgaggctttggaacaggccgtgaaggaagtcttggataaggggatcagaacggcggatttgagaggtagtagcacaaccactgaagtcggtgatgccgttgctgaaaccgtctccagaatcttgaaagaagctaaggcttga

SEQ ID NO: 388 - DNA, 21 bp, Artificial Sequence
  Description of Artificial Sequence: Synthetic oligonucleotide
ttccgcttaatggagtccaaa

SEQ ID NO: 389 - DNA, 22 bp, Artificial Sequence
  Description of Artificial Sequence: Synthetic oligonucleotide
gcatacaacggaaatttgcttt

SEQ ID NO: 390 - DNA, 20 bp, Artificial Sequence
  Description of Artificial Sequence: Synthetic oligonucleotide
taaacgttgggcaaccttgg

SEQ ID NO: 391 - DNA, 36 bp, Artificial Sequence; identical to SEQ ID NO: 189
  Description of Artificial Sequence: Synthetic oligonucleotide

SEQ ID NO: 392 - DNA, 31 bp, Artificial Sequence; identical to SEQ ID NO: 190
  Description of Artificial Sequence: Synthetic oligonucleotide

SEQ ID NO: 393 - DNA, 24 bp, Artificial Sequence
  Description of Artificial Sequence: Synthetic oligonucleotide
gaatagaagagagtgactcttttg

SEQ ID NO: 394 - DNA, 27 bp, Artificial Sequence
  Description of Artificial Sequence: Synthetic oligonucleotide
gattgattgttatagtttctttctttc

SEQ ID NO: 395 - DNA, 19 bp, Artificial Sequence
  Description of Artificial Sequence: Synthetic oligonucleotide
ctgcaggcatgatgatctg

SEQ ID NO: 396 - DNA, 25 bp, Artificial Sequence
  Description of Artificial Sequence: Synthetic oligonucleotide
atcgattaaattctttaattgaggg

SEQ ID NO: 397 - DNA, 24 bp, Artificial Sequence
  Description of Artificial Sequence: Synthetic oligonucleotide
gaatagaagagagtgactcttttg

SEQ ID NO: 398 - DNA, 36 bp, Artificial Sequence; identical to SEQ ID NO: 199
  Description of Artificial Sequence: Synthetic oligonucleotide

SEQ ID NO: 399 - DNA, 43 bp, Artificial Sequence; identical to SEQ ID NO: 200
  Description of Artificial Sequence: Synthetic oligonucleotide

SEQ ID NO: 400 - DNA, 48 bp, Artificial Sequence
  Description of Artificial Sequence: Synthetic oligonucleotide
ccctcaattaaagaatttaatcgatatgaatgctaatgccgttaagtc

SEQ ID NO: 401 - DNA, 47 bp, Artificial Sequence
  Description of Artificial Sequence: Synthetic oligonucleotide
tcaaaagagtcactctcttctattcttacccaaacattgcaagctgt

SEQ ID NO: 402 - DNA, 54 bp, Artificial Sequence
  Description of Artificial Sequence: Synthetic oligonucleotide
ccctcaattaaagaatttaatcgatatgaccaaaacggttgtaataggatcagg

SEQ ID NO: 403 - DNA, 47 bp, Artificial Sequence
  Description of Artificial Sequence: Synthetic oligonucleotide
tcaaaagagtcactctcttctattcttacgcgtggccctccaacatt

SEQ ID NO: 404 - DNA, 60 bp, Artificial Sequence
  Description of Artificial Sequence: Synthetic oligonucleotide
ccctcaattaaagaatttaatcgatatgagtgacaagcctttgttaacacatgctacaga

SEQ ID NO: 405 - DNA, 47 bp, Artificial Sequence
  Description of Artificial Sequence: Synthetic oligonucleotide
tcaaaagagtcactctcttctattcttaagcggcaggaggggcggca

SEQ ID NO: 406 - DNA, 49 bp, Artificial Sequence
  Description of Artificial Sequence: Synthetic oligonucleotide
ccctcaattaaagaatttaatcgatatggcagaaatgttcaatggaaac

SEQ ID NO: 407 - DNA, 47 bp, Artificial Sequence
  Description of Artificial Sequence: Synthetic oligonucleotide
tcaaaagagtcactctcttctattcttaaggtataatcggttcgacg

SEQ ID NO: 408 - DNA, 48 bp, Artificial Sequence
  Description of Artificial Sequence: Synthetic oligonucleotide
aagaaagaaactataacaatcaatcatgaatgctaatgccgttaagtc

SEQ ID NO: 409 - DNA, 47 bp, Artificial Sequence; identical to SEQ ID NO: 401
  Description of Artificial Sequence: Synthetic oligonucleotide

SEQ ID NO: 410 - DNA, 54 bp, Artificial Sequence
  Description of Artificial Sequence: Synthetic oligonucleotide
aagaaagaaactataacaatcaatcatgaccaaaacggttgtaataggatcagg

SEQ ID NO: 411 - DNA, 47 bp, Artificial Sequence; identical to SEQ ID NO: 403
  Description of Artificial Sequence: Synthetic oligonucleotide

SEQ ID NO: 412 - DNA, 60 bp, Artificial Sequence
  Description of Artificial Sequence: Synthetic oligonucleotide
aagaaagaaactataacaatcaatcatgagtgacaagcctttgttaacacatgctacaga

SEQ ID NO: 413 - DNA, 47 bp, Artificial Sequence; identical to SEQ ID NO: 405
  Description of Artificial Sequence: Synthetic oligonucleotide

SEQ ID NO: 414 - DNA, 49 bp, Artificial Sequence
  Description of Artificial Sequence: Synthetic oligonucleotide
aagaaagaaactataacaatcaatcatggcagaaatgttcaatggaaac

SEQ ID NO: 415 - DNA, 47 bp, Artificial Sequence; identical to SEQ ID NO: 407
  Description of Artificial Sequence: Synthetic oligonucleotide

SEQ ID NO: 416 - DNA, 47 bp, Artificial Sequence
  Description of Artificial Sequence: Synthetic oligonucleotide
ccctcaattaaagaatttaatcgatatggcaaccctatctgacttgg

SEQ ID NO: 417 - DNA, 51 bp, Artificial Sequence
  Description of Artificial Sequence: Synthetic oligonucleotide
tcaaaagagtcactctcttctattcttagctccacacatccatcaataatc

SEQ ID NO: 418 - DNA, 49 bp, Artificial Sequence
  Description of Artificial Sequence: Synthetic oligonucleotide
ccctcaattaaagaatttaatcgatatgttcattttggtgttgttgacc

SEQ ID NO: 419 - DNA, 47 bp, Artificial Sequence
  Description of Artificial Sequence: Synthetic oligonucleotide
tcaaaagagtcactctcttctattcttactccactggctttacctgc

SEQ ID NO: 420 - DNA, 47 bp, Artificial Sequence
  Description of Artificial Sequence: Synthetic oligonucleotide
ccctcaattaaagaatttaatcgatatgagtgcccatgccttgccaa

SEQ ID NO: 421 - DNA, 54 bp, Artificial Sequence
  Description of Artificial Sequence: Synthetic oligonucleotide
tcaaaagagtcactctcttctattcttaagcggtatcacctttagttctagtgc

SEQ ID NO: 422 - DNA, 50 bp, Artificial Sequence
  Description of Artificial Sequence: Synthetic oligonucleotide
ccctcaattaaagaatttaatcgatatgacaaacttcttgatcgttgtgg

SEQ ID NO: 423 - DNA, 47 bp, Artificial Sequence
  Description of Artificial Sequence: Synthetic oligonucleotide
tcaaaagagtcactctcttctattcttacgtcctctcttgggcctca

SEQ ID NO: 424 - DNA, 26 bp, Artificial Sequence
  Description of Artificial Sequence: Synthetic oligonucleotide
gatccacaagttttcactagaattgg

SEQ ID NO: 425 - DNA, 42 bp, Artificial Sequence
  Description of Artificial Sequence: Synthetic oligonucleotide
cactgcttaattaagcgctgtcactcttatatcagtatgacc

SEQ ID NO: 426 - DNA, 41 bp, Artificial Sequence
  Description of Artificial Sequence: Synthetic oligonucleotide
cactgcggatccggtaccccaccacgacaacaggattcccc

SEQ ID NO: 427 - DNA, 52 bp, Artificial Sequence
  Description of Artificial Sequence: Synthetic oligonucleotide
cgagatttaattaattagccaacaggacaatagagttaaaaagaatgaattg

SEQ ID NO: 428 - DNA, 56 bp, Artificial Sequence
  Description of Artificial Sequence: Synthetic oligonucleotide
cgagatctgcaggcggccgcttctgtgagtatttgttattgaaaatgaagggatgg

SEQ ID NO: 429 - DNA, 42 bp, Artificial Sequence
  Description of Artificial Sequence: Synthetic oligonucleotide
ccacgtcggtaccgagatcgttgccgaggcaatcaagtcctt

SEQ ID NO: 430 - DNA, 50 bp, Artificial Sequence
  Description of Artificial Sequence: Synthetic oligonucleotide
aacggcttcgtctaaacaaccacggatcttcaacaatccctgttctggac

SEQ ID NO: 431 - DNA, 50 bp, Artificial Sequence
  Description of Artificial Sequence: Synthetic oligonucleotide
gtccagaacagggattgttgaagatccgtggttgtttagacgaagccgtt

SEQ ID NO: 432 - DNA, 45 bp, Artificial Sequence
  Description of Artificial Sequence: Synthetic oligonucleotide
agtgtttgtgtccggtaacgaccgaaatattacaattggagctcc

SEQ ID NO: 433 - DNA, 45 bp, Artificial Sequence
  Description of Artificial Sequence: Synthetic oligonucleotide
ggagctccaattgtaatatttcggtcgttaccggacacaaacact

SEQ ID NO: 434 - DNA, 19 bp, Artificial Sequence
  Description of Artificial Sequence: Synthetic oligonucleotide
tttcagcaacggcatcacc

SEQ ID NO: 435 - DNA, 22 bp, Artificial Sequence
  Description of Artificial Sequence: Synthetic oligonucleotide
acctttatgccaacatcagacc

SEQ ID NO: 436 - DNA, 47 bp, Artificial Sequence
  Description of Artificial Sequence: Synthetic oligonucleotide
aacggcttcgtctaaacaacccatcaacggtgtacttttcagtatcc

SEQ ID NO: 437 - DNA, 47 bp, Artificial Sequence
  Description of Artificial Sequence: Synthetic oligonucleotide
ggatactgaaaagtacaccgttgatgggttgtttagacgaagccgtt

SEQ ID NO: 438 - DNA, 42 bp, Artificial Sequence
  Description of Artificial Sequence: Synthetic oligonucleotide
ttgcaatgccatgaacgcccgaaatattacaattggagctcc

SEQ ID NO: 439 - DNA, 42 bp, Artificial Sequence
  Description of Artificial Sequence: Synthetic oligonucleotide
ggagctccaattgtaatatttcgggcgttcatggcattgcaa

SEQ ID NO: 440 - DNA, 20 bp, Artificial Sequence
  Description of Artificial Sequence: Synthetic oligonucleotide
cagatggcaacaatcccaag

SEQ ID NO: 441 - DNA, 18 bp, Artificial Sequence
  Description of Artificial Sequence: Synthetic oligonucleotide
aattaacctatggtgcac

SEQ ID NO: 442 - DNA, 23 bp, Artificial Sequence
  Description of Artificial Sequence: Synthetic oligonucleotide
ttaattaaaagcttggcgtaatc

SEQ ID NO: 443 - DNA, 32 bp, Artificial Sequence
  Description of Artificial Sequence: Synthetic oligonucleotide
ctcgtgctagtcagtcttgcacgctttgggtg

SEQ ID NO: 444 - DNA, 44 bp, Artificial Sequence
  Description of Artificial Sequence: Synthetic oligonucleotide
atgattacgccaagcttttaattaacaacacggcgtctgaggac

SEQ ID NO: 445 - DNA, 45 bp, Artificial Sequence
  Description of Artificial Sequence: Synthetic oligonucleotide
actgagagtgcaccataggttaattaactcggggccgtcggtgga

SEQ ID NO: 446 - DNA, 37 bp, Artificial Sequence
  Description of Artificial Sequence: Synthetic oligonucleotide
aagcgtgcaagactgactagcacgagcgaagatgggg

SEQ ID NO: 447 - DNA, 18 bp, Artificial Sequence
  Description of Artificial Sequence: Synthetic oligonucleotide
ctcggggccgtcggtgga

SEQ ID NO: 448 - DNA, 23 bp, Artificial Sequence
  Description of Artificial Sequence: Synthetic oligonucleotide
caacacggcgtctgaggacttgg

SEQ ID NO: 449 - DNA, 26 bp, Artificial Sequence
  Description of Artificial Sequence: Synthetic oligonucleotide
gctcaacaattgtctgacaagatctc

SEQ ID NO: 450 - DNA, 28 bp, Artificial Sequence
  Description of Artificial Sequence: Synthetic oligonucleotide
gagattgttaactttatggggcaataac

SEQ ID NO: 451 - DNA, 44 bp, Artificial Sequence
  Description of Artificial Sequence: Synthetic oligonucleotide
tccccatcttcgctcgtgctagtcaaagggaagaagagtcgttg

SEQ ID NO: 452 - DNA, 44 bp, Artificial Sequence
  Description of Artificial Sequence: Synthetic oligonucleotide
cgtcggcacccaaagcgtgcaagacgtcgacctaaattcgcaac

SEQ ID NO: 453 - DNA, 31 bp, Artificial Sequence
  Description of Artificial Sequence: Synthetic oligonucleotide
gtgctagtcaagataaaccgaggcatggaag

SEQ ID NO: 454 - DNA, 32 bp, Artificial Sequence
  Description of Artificial Sequence: Synthetic oligonucleotide
cgtgcaagacgcatagactgcaagtaagcagc

SEQ ID NO: 455 - DNA, 30 bp, Artificial Sequence
  Description of Artificial Sequence: Synthetic oligonucleotide
cagtctatgcgtcttgcacgctttgggtgc

SEQ ID NO: 456 - DNA, 32 bp, Artificial Sequence
  Description of Artificial Sequence: Synthetic oligonucleotide
cggtttatcttgactagcacgagcgaagatgg

SEQ ID NO: 457 - DNA, 31 bp, Artificial Sequence
  Description of Artificial Sequence: Synthetic oligonucleotide
aaaggaataagctgggtgtttgctcattttg

SEQ ID NO: 458 - DNA, 43 bp, Artificial Sequence
  Description of Artificial Sequence: Synthetic oligonucleotide
cgttagtcatttttgttaattggtgttttgtttaataatgggg

SEQ ID NO: 459 - DNA, 36 bp, Artificial Sequence
  Description of Artificial Sequence: Synthetic oligonucleotide
aattaacaaaaatgactaacgcaccacaaaacattg

SEQ ID NO: 460 - DNA, 47 bp, Artificial Sequence
  Description of Artificial Sequence: Synthetic oligonucleotide
aacacccagcttattcctttatagcataacttcttctaaacttgtcg

SEQ ID NO: 461 - DNA, 31 bp, Artificial Sequence
  Description of Artificial Sequence: Synthetic oligonucleotide
aaagtcataggctgggtgtttgctcattttg

SEQ ID NO: 462 - DNA, 43 bp, Artificial Sequence
  Description of Artificial Sequence: Synthetic oligonucleotide
aacttagcatttttgttaattggtgttttgtttaataatgggg

SEQ ID NO: 463 - DNA, 34 bp, Artificial Sequence
  Description of Artificial Sequence: Synthetic oligonucleotide
aattaacaaaaatgctaagtttcatcaccgaagc

SEQ ID NO: 464 - DNA, 40 bp, Artificial Sequence
  Description of Artificial Sequence: Synthetic oligonucleotide
aacacccagcctatgactttatacatgtaacggatccgtc

SEQ ID NO: 465 - DNA, 31 bp, Artificial Sequence
  Description of Artificial Sequence: Synthetic oligonucleotide
gttctggtgagctgggtgtttgctcattttg

SEQ ID NO: 466 - DNA, 43 bp, Artificial Sequence
  Description of Artificial Sequence: Synthetic oligonucleotide
agactgacatttttgttaattggtgttttgtttaataatgggg

SEQ ID NO: 467 - DNA, 33 bp, Artificial Sequence
  Description of Artificial Sequence: Synthetic oligonucleotide
aattaacaaaaatgtcagtctcgcctttcgttg

SEQ ID NO: 468 - DNA, 41 bp, Artificial Sequence
  Description of Artificial Sequence: Synthetic oligonucleotide
aacacccagctcaccagaacttccattctttaacgtttatc

SEQ ID NO: 469 - DNA, 31 bp, Artificial Sequence
  Description of Artificial Sequence: Synthetic oligonucleotide
cggtttataggctgggtgtttgctcattttg

SEQ ID NO: 470 - DNA, 40 bp, Artificial Sequence
  Description of Artificial Sequence: Synthetic oligonucleotide
aacacccagcctataaaccgatatagtcctcccagttttc

SEQ ID NO: 471 - DNA, 43 bp, Artificial Sequence
  Description of Artificial Sequence: Synthetic oligonucleotide
ctgaatacatttttgttaattggtgttttgtttaataatgggg

SEQ ID NO: 472 - DNA, 34 bp, Artificial Sequence
  Description of Artificial Sequence: Synthetic oligonucleotide
aattaacaaaaatgtattcagcttcagtcacagc

SEQ ID NO: 473 - DNA, 32 bp, Artificial Sequence
  Description of Artificial Sequence: Synthetic oligonucleotide
gattactttaagctgggtgtttgctcattttg

SEQ ID NO: 474 - DNA, 43 bp, Artificial Sequence
  Description of Artificial Sequence: Synthetic oligonucleotide
ctgatgacatttttgttaattggtgttttgtttaataatgggg

SEQ ID NO: 475 - DNA, 39 bp, Artificial Sequence
  Description of Artificial Sequence: Synthetic oligonucleotide
aattaacaaaaatgtcatcagaatacgctaaactagtgg

SEQ ID NO: 476 - DNA, 49 bp, Artificial Sequence
  Description of Artificial Sequence: Synthetic oligonucleotide
aacacccagcttaaagtaatctatgtatctcagtatcttggtacttttc

SEQ ID NO: 477 - DNA, 31 bp, Artificial Sequence
  Description of Artificial Sequence: Synthetic oligonucleotide
atccaaataggctgggtgtttgctcattttg

SEQ ID NO: 478 - DNA, 43 bp, Artificial Sequence
  Description of Artificial Sequence: Synthetic oligonucleotide
tatcagacatttttgttaattggtgttttgtttaataatgggg

SEQ ID NO: 479 - DNA, 34 bp, Artificial Sequence
  Description of Artificial Sequence: Synthetic oligonucleotide
aattaacaaaaatgtctgataaagcagccgctag

SEQ ID NO: 480 - DNA, 37 bp, Artificial Sequence
  Description of Artificial Sequence: Synthetic oligonucleotide
aacacccagcctatttggatctcttgtaaaccttgcc

SEQ ID NO: 481 - DNA, 32 bp, Artificial Sequence
  Description of Artificial Sequence: Synthetic oligonucleotide
taccaaactaagctgggtgtttgctcattttg

SEQ ID NO: 482 - DNA, 35 bp, Artificial Sequence
  Description of Artificial Sequence: Synthetic oligonucleotide
aacacccagcttagtttggtaacccactttcgttg

SEQ ID NO: 483 - DNA, 44 bp, Artificial Sequence
  Description of Artificial Sequence: Synthetic oligonucleotide
cttttgcacatttttgttaattggtgttttgtttaataatgggg

SEQ ID NO: 484 - DNA, 36 bp, Artificial Sequence
  Description of Artificial Sequence: Synthetic oligonucleotide
ccaattaacaaaaatgtcaaaagcttttagtgcccc

SEQ ID NO: 485 - DNA, 751 bp, Artificial Sequence; identical to SEQ ID NO: 113
  Description of Artificial Sequence: Synthetic polynucleotide

SEQ ID NO: 486 - DNA, 531 bp, Artificial Sequence; identical to SEQ ID NO: 117
  Description of Artificial Sequence: Synthetic polynucleotide

SEQ ID NO: 487 - DNA, 415 bp, Artificial Sequence; identical to SEQ ID NO: 55
  Description of Artificial Sequence: Synthetic polynucleotide

SEQ ID NO: 488 - DNA, 745 bp, Artificial Sequence; identical to SEQ ID NO: 118
  Description of Artificial Sequence: Synthetic polynucleotide

SEQ ID NO: 489 - DNA, 614 bp, Artificial Sequence; identical to SEQ ID NO: 119
  Description of Artificial Sequence: Synthetic polynucleotide

SEQ ID NO: 490 - DNA, 360 bp, Artificial Sequence
  Description of Artificial Sequence: Synthetic polynucleotide
agataaaccgaggcatggaagaagtcagagacttcctaattgggaaatatcacatgaaaatgtatggatgtgtgcaggacacgtctactgagtgccatactttgtgcccaccgcgaaattaagggcagccatcagattacgtaagcagtggtatgcagttgttacagcgtcaagtttttctgtattaccccaaagttttcttctctcccctgcaaaagttttcatatgcaaaactgatcccacagcagtataaatacccaataactttccccaaccaacagcaacaacctctcattcttttttttcctattcttttctttaatcaacccccattattaaacaaaacaccaattaacaaaa

SEQ ID NO: 491 - DNA, 500 bp, Artificial Sequence
  Description of Artificial Sequence: Synthetic polynucleotide
gtcttgcacgctttgggtgccgacgacgccttggcccactcaagtattagattcggtattggtagattcaccactgaggcagaggtcgactatgtcatcaaggctattaacgaaagagttgatttcttgagaaagatgtctccattgtgggagatggtgcaagaaggcattgacttggactcaattgaatggagtggtcattagtgtgaccccctatcgctacggtcttcctcttcgtttcatttaagtatgacttgttttgtttatttatctcgtgtatagaatagtaattatttttggtataagccatgttggtattcgtgagtcagatgtgagctgtatgttctcctgaaccggcgtaacttcccttccgttgccgcgggaatgcgacaacaacgacgggaaaaaaatcccagtataaaaccaccccaaatgacgtgtgtgaaatttttcactccaggtttctctccctcttttttgtccccccaaaccaatcacca

SEQ ID NO: 492 - DNA, 184 bp, Artificial Sequence; identical to SEQ ID NO: 116
  Description of Artificial Sequence: Synthetic polynucleotide

SEQ ID NO: 493 - DNA, 267 bp, Artificial Sequence; identical to SEQ ID NO: 56
  Description of Artificial Sequence: Synthetic polynucleotide

SEQ ID NO: 494 - DNA, 374 bp, Artificial Sequence
  Description of Artificial Sequence: Synthetic polynucleotide
gctgggtgtttgctcattttgtttcaatgcatggatgcacactggtctttttatgatttgaaatgaatagatttgatcatcatcattttttttttgcaaatatttatcatataatgtgagttttctttggtgtatatttgttttctacagtatttagataatattatttgaaaagaatatatgcttaaaagaaactacaagttagagttcgacgatgaagtggttgtcatgtcggcgactttaccccagagtaagaaggaattgtcgtggtcgatattggttgaaacatatcgggactagtcttgcgaccgagcgcagggcaattgtggagtcacacatacaatgaaaattggctgcttacttgcagtctatgc

SEQ ID NO: 495 - DNA, 300 bp, Artificial Sequence
  Description of Artificial Sequence: Synthetic polynucleotide
ggatcctctacatatgaacattctatattgaaaaatgcatgtatattattgtcgttaacgttttttaaaaattcatggtcttttctaaaaatgcagatagttgagcaacagaatcctctttatcaatcaccacaaccaccgactgtttgctactctcattcgtaacaatgaatctattcgacgtgaccgtagcctcactagactcagattggctggtgttcctcgcaagattgggttcttcattaggcgagtaaaactcctcttcctcgtcctcctccccatcttcgctcgtgctagtca

SEQ ID NO: 496 - protein, 50 aa, Candida viswanathii
MFNFKLSQQVLKNSTKSIMPILKKPFSTSHAKGDLFKYQSQLPKLPVPTL

SEQ ID NO: 497 - protein, 32 aa, Artificial Sequence
  Description of Artificial Sequence: Synthetic polypeptide
MPILKKPFSTSHAKGDLFKYQSQLPKLPVPTL

SEQ ID NO: 498 - protein, 32 aa, Artificial Sequence; identical to SEQ ID NO: 497
  Description of Artificial Sequence: Synthetic polypeptide

SEQ ID NO: 499 - protein, 50 aa, Artificial Sequence; identical to SEQ ID NO: 496
  Description of Artificial Sequence: Synthetic polypeptide

SEQ ID NO: 500 - protein, 27 aa, Candida viswanathii
KWYLVDSANEMKDVLTKGLLTDAKPKL

SEQ ID NO: 501 - protein, 27 aa, Artificial Sequence
  Description of Artificial Sequence: Synthetic peptide
KWYLVDSANEMKDVLTKGLLTDAKPKL

SEQ ID NO: 502 - protein, 24 aa, Artificial Sequence
  Description of Artificial Sequence: Synthetic peptide
KWYLVDSANEMKDVLTKGLLTDAK

SEQ ID NO: 503 - protein, 24 aa, Artificial Sequence
  Description of Artificial Sequence: Synthetic peptide
KWYLVDSANEMKDVLTKGLLTDAK

SEQ ID NO: 504 - protein, 17 aa, Candida viswanathii
MSTYQFQETLEKLPIPD

SEQ ID NO: 505 - protein, 49 aa, Artificial Sequence
  Description of Artificial Sequence: Synthetic polypeptide
MFNFKLSQQVLKNSTKSIMPILKKPFSTSHAKGSTYQFQETLEKLPIPD

SEQ ID NO: 506 - protein, 41 aa, Artificial Sequence
  Description of Artificial Sequence: Synthetic polypeptide
MSALRSFQRSSNVAKSTLKNSVRTYSTYQFQETLEKLPIPD

SEQ ID NO: 507 - protein, 46 aa, Artificial Sequence
  Description of Artificial Sequence: Synthetic polypeptide
MLSRTTLRVARQQTRLLSTSRILFNSKTDQSTYQFQETLEKLPIPD

SEQ ID NO: 508 - protein, 636 aa, Candida viswanathii
MPTELQKERELTKFNPKELNYFLEGSQERSEIISNMVEQMQKDPILKVDASYYNLTKDQQREVTAKKIARLSRYFEHEYPDQQAQRLSILGVFDPQVFTRIGVNLGLFVSCVRGNGTNSQFFYWTINKGIDKLRGIYGCFGMTELAHGSNVQGIETTATFDEDTDEFVINTPHIGATKWWIGGAAHSATHCSVYARLKVKGKDYGVKTFVVPLRDSNHDLEPGVTVGDIGAKMGRDGIDNGWIQFSNVRIPRFFMLQKYCKVSRSGEVTMPPSEQLSYSALIGGRVTMMMDSYRMTSRFITIALRYAIHRRQFKKKDTDTIETKLIDYPLHQKRLFPFLAAAYLFSQGALYLEQTMNATNDKLDEAVSAGEKEAIDAAIVESKKLFVASGCLKSTCTWLTAEAIDEARQACGGHGYSSYNGFGKAYSDWVVQCTWEGDNNILAMNVAKPMVRDLLKEPEQKGLVLSSVADLDDPAKLVKAFDHALSGLARDIGAVAEDKGFDITGPSLVLVSKLNAHRFLIDGFFKRITPEWSEVLRPLGFLYADWILTNFGATFLQYGIITPDVSRKISSEHFPALCAKVRPNVVGLTDGFNLTDMMTNAAIGRYDGNVYEHYFETVKALNPPENTKAPYSKALE

SEQ ID NO: 509 - DNA, 24 bp, Artificial Sequence
  Description of Artificial Sequence: Synthetic oligonucleotide
  modified_base (4)..(6): a, c, t, g, unknown or other
  modified_base (8)..(8): a, c, t, g, unknown or other
  modified_base (10)..(21): a, c, t, g, unknown or other
  misc_feature (10)..(21): This region may encompass 9-12 nucleotides
cggnnntnannnnnnnnnnnnccg

SEQ ID NO: 510 - DNA, 24 bp, Artificial Sequence
  Description of Artificial Sequence: Synthetic oligonucleotide
  modified_base (4)..(6): a, c, t, g, unknown or other
  modified_base (8)..(8): a, c, t, g, unknown or other
  modified_base (10)..(21): a, c, t, g, unknown or other
  misc_feature (10)..(21): This region may encompass 8-12 nucleotides
cggnnntnrnnnnnnnnnnnnccg

SEQ ID NO: 511 - DNA, 48 bp, Artificial Sequence
  Description of Artificial Sequence: Synthetic oligonucleotide
  modified_base (7)..(42): a, c, t, g, unknown or other
  misc_feature (7)..(42): This region may encompass 4-36 nucleotides
cyccrdnnnnnnnnnnnnnnnnnnnnnnnnnnnnnnnnnnnnhyggrg

SEQ ID NO: 512 - DNA, 24 bp, Artificial Sequence
  Description of Artificial Sequence: Synthetic oligonucleotide
  modified_base (4)..(6): a, c, t, g, unknown or other
  modified_base (10)..(21): a, c, t, g, unknown or other
cggnnnttannnnnnnnnnnncag

SEQ ID NO: 513 - DNA, 24 bp, Artificial Sequence
  Description of Artificial Sequence: Synthetic oligonucleotide
cggttattacgcctgggggggcag

SEQ ID NO: 514 - DNA, 13 bp, Artificial Sequence
  Description of Artificial Sequence: Synthetic oligonucleotide
  modified_base (7)..(7): a, c, t, g, unknown or other
cttgtgncatgtg

SEQ ID NO: 515 - protein, 9 aa, Artificial Sequence
  Description of Artificial Sequence: Synthetic peptide
DYKDDDDKG

SEQ ID NO: 516 - protein, 14 aa, Artificial Sequence
  Description of Artificial Sequence: Synthetic peptide
GKPIPNPLLGLDST

SEQ ID NO: 517 - protein, 10 aa, Artificial Sequence
  Description of Artificial Sequence: Synthetic peptide
EQKLISEEDL

SEQ ID NO: 518 - protein, 11 aa, Artificial Sequence
  Description of Artificial Sequence: Synthetic peptide
QPELAPEDPED

SEQ ID NO: 519 - protein, 9 aa, Artificial Sequence
  Description of Artificial Sequence: Synthetic peptide
YPYDVPDYA

SEQ ID NO: 520 - protein, 11 aa, Artificial Sequence
  Description of Artificial Sequence: Synthetic peptide
YTDIEMNRLGK

SEQ ID NO: 521 - protein, 6 aa, Artificial Sequence
  Description of Artificial Sequence: Synthetic 6xHis tag
HHHHHH

SEQ ID NO: 522 - protein, 7 aa, Artificial Sequence
  Description of Artificial Sequence: Synthetic peptide
  MOD_RES (3)..(5): Any amino acid
  MISC_FEATURE (3)..(5): This region may encompass 1-3 residues
CCXXXCC

SEQ ID NO: 523 - protein, 6 aa, Artificial Sequence
  Description of Artificial Sequence: Synthetic peptide
CCPGCC

SEQ ID NO: 524 - protein, 6 aa, Unknown
  Description of Unknown: Thrombin recognition site sequence
LVPRGS

SEQ ID NO: 525 - protein, 5 aa, Artificial Sequence
  Description of Artificial Sequence: Synthetic peptide
DDDDK

SEQ ID NO: 526 - protein, 7 aa, Tobacco etch virus
ENLYFQG

SEQ ID NO: 527 - protein, 8 aa, Artificial Sequence
  Description of Artificial Sequence: Synthetic peptide
LEVLFQGP

What is claimed is:

1. A genetically modified microorganism, comprising:
one or more heterologous nucleic acids encoding one or more terpene biosynthesis polypeptides, wherein expression of at least one of the heterologous nucleic acids is regulated by a nucleic acid that provides for fatty acid or alkane induction of expression of the terpene biosynthesis polypeptide:
wherein the one or more heterologous nucleic acids that encode one or more terpene biosynthesis polypeptides is selected from the group consisting of terpene synthase, phytoene synthase, geranylgeranyl diphosphate synthase, phytoene desaturase, lycopene cyclase, bifunctional lycopene cyclase/phytoene synthase, β-carotene ketolase, β-carotene hydroxylase, astaxanthin synthase, zeaxanthin glucosyltransferase and valencene synthase,
wherein the nucleic acid that provides for said fatty acid induction of expression of the terpene biosynthesis polypeptide is a promoter,
wherein the genetically modified microorganism is a yeast selected from the group consisting of *Candida* ssp and *Blastobotrys* ssp., and
wherein said genetically modified microorganism provides for terpene biosynthesis.

2. The microorganism of claim 1, wherein the fatty acid is a saturated fatty acid or an unsaturated fatty acid selected from one or more of oleic acid, palmitoleic acid, erucic acid, linoleic acid, palmitic acid, caproic acid, enanthic acid, caprylic acid, pelargonic acid, capric acid, undecylic acid, lauric acid, myristic acid, pentadecanoic acid, margaric acid, stearic acid, arachidic acid, behenic acid, tridecylic acid, methyl pentadecanoate, ethyl laurate, ethyl PFAD and linolenic acid, and wherein the alkane is selected from one or more of hexane, heptane, nonane, decane, undecane, dodecane, tridecane, tetradecane, pentadecane, hexadecane, heptadecane, and octadecane.

3. The microorganism of claim 1, wherein the nucleic acid promoter that provides for said fatty acid induction of expression of said terpene biosynthesis polypeptide is selected from the group consisting of hydratase-dehydrogenase-epimerase (HDE), peroxisomal 18-kDa protein (POX18), 2,4-dienoyl-CoA reductase (SPS19), acyl-CoA oxidase 4 (POX4), dienoyl CoA Isomerase (DCI) and acyl-CoA oxidase (POX5).

\* \* \* \* \*